United States Patent 12,790,634 (MOST PROBABLE NUMBER ANALYSIS OF HETEROGENOUS POPULATIONS) - sequence listing, part 9

SEQ ID NO: 4 - DNA, 7383262 bp, unidentified (residues 5,537,449-7,383,262 of 7,383,262)
  source 1..7383262: mol_type = genomic DNA; note = Hungatella effluvii
tcactatccgctggcggtgacctataagaccggctttgaggtggaaacagtgccggagacgtgttcgcttctgatggaccggggcgcggtaaaggatacgtggcgtatgacgctgaacggggaagaaatcggtgctgagacattccggagcgtatttatcaatgatcagaacaataggatggcggacatagccccatttctgaaaaagggctggaatgaactggcggtggaagtgatgctcacgaaggattctgacgggatccgggatccgctctacttatatggagacttcggtgtgagtgagacggaggcagcaggccgcagaagactcactgcgaaaccggagactgcggcgtttacgctggattacatcaggggattcccctactacagcgggacgttcaccttccggactgtgcttgatgtgaagacggttccacaattgtttgacttagagctggataagaaggatcagtgccatgaatgcctggaaatcatagtaaacggtgtttccaccggtgtgcgggcattttccccgtatacgtggcacggggacggagcgatgttaaggcagggagaaaatcagatagaaatccgtctcaccaatactctcgcccccatgcttgacggaacctggtttgattatgagaaacactgtcttgtaaaatgttaagaggagaagcttatgaaaccaaatgtgattgttttttttacggaccagcagcgatcggatactaccggggcgggcggtaatccctgcggattgacgccgaactttgaccgggtggcatttacggggacgtacgcatcgactgcggttacgccccagccggtgtgcgggccggccagggcggtgctgcagactggaaaatacgctacctgtacgggaaattaccggaacgcgattcctctgggaagagatcagaggaccatggcccattacttccatgacgccgggtatgacaccgcttatatcggtaaatggcatctggcgtcggggcggcacgaggtccagaaggaggagcgcggcggatatgactggtggctgggcgccaatgccctggaggctacctccagaccgtacgatacccttgtatatgacaatgagaaccagccggtgaagctgccggggcaccgaattgatgccctgacggatgccgcggtccgctacatcgatggccaccaggaccaggataagccgttcttcctattcctgtcctttttggagcctcatttccaaaattgtttcgacgatttttcagcccctcacagcggggctcccatcaatccgctttatatgccgccggatttaggcgcgctcggcggcacgtcatggcagcacctgggcggatactacggtatggtgaaacggctggatgaggccttcggacgaatccgggatgcactggaaagccttcatatgacggaggacaccatcctgttgttcaccagcgatcacggatgccatttcaagacgcggaatgcggaatataagcgttcctgccatgaaagctctgtccgaattccaatggcattttacggaccgggatttacagggggcggcaatgttgcggagattgtcagcctgatcgatgttgcaccgacccttctcgacgcatgcgggattccggttccggaggatatgcagggccactccctcatgcctctgctgggcggaaagaaagctccgtggccgaaggaggcgctcatccagatcagcgaggcggaggtcggccgggccataaggacgaaacggtggaagtattcggttcaggccactgaccgggatccggttttagaccagggaagcggcgtgtacaccgagatgtatctctacgacctggaacacgatccttatgaactccataatctgattcattccagggtccaccagggggtatgcctcgcgctgggggagaaattggtcaagcttatgaaggaggcgggagaaggagaggctgtgattctgccgcaggagaaggagaagattggacagctggccgtgtttgatggggaagagctgttatagaaaataaactggtgaaaaaaatatgtttgacacatcaggttcagatggtttataataaaggtacaaaaaaggcagttcactccacagagtggcttccaaagattcgttatattttaaagaaaatagtcgctgcttttggacgggtgggcgactatttttttgtaccattttttctatctatgtaaacgagaatagcaatgataagcattgctgcatttatgatagtcataaattcttcgtaagtagacataatatagaaccacctcctttcggagatggaagtcacccagcagataaactgcctaataaaattataacagagtatataactaatttcaatgtatatttaactatatatgagcgtgattaaagataagggttacttttcacgggctggggaatatggaagaaacagaagatgacgcagatggatttagcaaaagctacaggaaataagcagcaggttatattaagaatagaaaagcgggaaaatagtccaacattgaaaactttctgcggtttactgaatacgcttggatatgatctgcaaattgtgaaacgtggtaaagtatgaggtctgaagcagctgtcaatagacataccgattatgattgaaatcaaaggatttccatagtctgtatgtcttttttttatataaattacttttgtgataagcaatatgcatataagaaaaaacgaagaagaataaaatttaaacatattttacaaatatatcttgacatccgtgctacaatcgtatatcatataaatacatcatataacgttatataacaatatataataatatcgagtggaggattcattatgagacaagagcacatcgaccagattaacacagcagtggcagcagtggcagccaaggaagtcattaatcatttttactttgtagcgtgtggaggttcccaggctttcatgatgccggcacagtacacctttgaccgtgagatttcaattccggccagcatctactcttccaacgaatttgttcacagagctccaaaggcattgggaccggattccgtagtcatcacctgttcccattcaggcaatactcctgagaccgtaaaggcaacggaggttgccagagaaaaaggtgcgctgaccatcgccttatctcacttagaggattctccattatggaacgccgccgaatatccgatccactatgactggggaaaagaggcggatgcaagcgatttgaacaaggctgtgctatactatctgatgttcagcattttaaacgcagtcaatccatgtgagaagtatgagaagggcatcgcttctgtagcgaatttaaatgacgcgatcgagaaggcgaaagctcagtatgcggacaccgttaaggcgtggggcagcaagtacaagagagagcagatgatctacaccatgggcagcggcgcctgctacggcgaggcatactcctttgccatctgcctgctgatggagatgcagtggattcattcccacgcgatccattccggcgaatatttccatggaccatttgaagtgactgattttgatgttccgttcatcatcatcgagggcatcggtgcaacgaggccgctcgatgagagagcttacaatttctgccagaagtattccgataagattatgctggtagatgcggaaacctttgatatgacaggcattgacgaggaagtgagagagtactttgctccgcttctggccggggcggtacttcgttccctggcagatgcatttgcatatgagagaggtcatgatttaagtgtgcgccgctatatgtggagaatggaatattaatctgaaccttgaaagaataagagagagcgacggagttttagcaggaaggctggaattccgtcgtttttagaaaagaacgaggaggatatcatatgaagaaaagtattaagaaaatcatggcacttgcactggctcttaccatgggactgtcactgaccgcatgcggcggggcaaaggatggcggggatgccaaggcaaccgcagcgccggagagtaaggcggcggataccactgcggcaggcggcgaagcgaaggcagaagagggatccggagagaaggtagtgattaacttcttccaccgctggcccaacgacccgaagaattccatgttccaggaactgatccaggaatacatggccgagaatccaaacgtcacgatcaacatggactgcatcttaaacgatcagtacaaagaaaaaatccgtatggtcgttgcgacagacgaagttccggatatcttctcttcctggtctggaacctttgcaaaagaaatgattgactccggcaatgtcatggagctgaacgacatctatgacggtgacaccgagtggtcctccaagattgcaggagccagcgtcgatggctttacctttgacggaaagatctatggggttccgtggtcgcaggatggcaaggctttctattataataagaagatattcgcagaaaacaacctggaagtgccgaagacatggaatgaatttatcgcggcgctggatactctgaaggcagccggttatgagacaccggtggttgagggattatccgataactgggcaattcttcactatctgggaaccatgaatcagagaatggtagatccggctgtgatcgcgaaggattacgatgcggcgactggtgaatttacagatccgacctacgtggaggtgcttgaaaaatggaaacagctcacctcctacatgggagatacctgtgtagccatcgatcatgaaacggccagaaatacatactttgcaaccggagaggctccgattatgtatttacagttcgcagagatcaccatgcttgaaaaggtcattccggaaggctttgaatacggcttcttcaatttcccggctttcgaagatggaaaaggcgatccggaaggactgaccggcgcaccggagggatttatgatcagcaacaaggctaagaatccggaagagtgtgtgaagttcttaaagtggctggtcagcaagaagggcggagaagctctgacaacaaagagcggagagatctccagcgtagcgggtgcagtggatgaaaccaatgccctcccggcacagctggaggcgatggagattatcaagtccgcatccacgctggtaccgtggtttgacaatgcctgcgacgcgtccgtttataccgtatacggccagggggcacaggcgattgctacaggcgacgagactccggaaagtgttatggaacaggtaaaggaggctgcggctgccttacattaataaaaggtaacggttcaggacatcggatgttctgaaccgttacaataaatgggatggatcataacattccgccgaatgcatatgaggggggactatccgcttgaaaagagagaaaaaaagaaatttacaggcattggcatttgccataccagctattctgattctgggaatattcgtatattttccgctgattaaaaattttatatacagttttcagtcctttaccctgtcttccacaacgaaggaatgggtggggctggataactacaggcatctgctttccgataagaccattttggtctctctgaaaaacaacatcctttatgctgtcatctctattgtcattcaggtgggattcggactcgtgctggcggcggtactggaggacatcgcattccataagtttgccccgacgctgcgcagtatctattttatccctaccgtgatatccatgaccgtcgtatgtctgttgtttgattttgtatacaacccacagatgggcctgttaaacagctttctggagctggtcggacttgacggcttaatgaggatatggctgggaagcaagaagacagcgatgtatgcggtgattgcggtttctcagtggcagagtaccgggtatgttgccatgctgttcattgtggccatccagaagatcccccgggatttatatgaggcggcagaggtggacggtgccggaaagctgaaacgctttttctacataacggtgccgcaggtgcgccagatgttctttgttaccatgattttaacggttgtcggtgcatttaccgtatttaacgaaccgtatatcttaaccggaggcgggccgggaacggcgaccatggtgctgtcgcttcatatgtaccagaccggtttcgttaagaacaatatgggatacgcctccacgattgccatgctgatttttgtcataacggcaattttatcttccgtacagttcgcaagcttcggaacggaaaaggaggatcgctgatggagaaggtgaaagtaaaaaagagaagagtatacggacccggagagatcctttggctggccattttattcctcctggccgccctgattttgtatccgctgttctggattctgatgtcgtcctttaaggactacaacggcatttacggcgatgtgtgggggcttcccgatatctggcatgtagaaaattatatgacagcctggaaccgggggatctcccagtatttcctcaacagcctgattgtaacgatatgtacgctggctggtgtggtctttgcatcgaccttttccgcatttggaatctgccagatgaagggcagactgggaaatttcgtatttctcttctgtctctgcggcctgctgctgtcaccgcaggtctgcctgcttccgctgttcatgctgctgaagagcctgaagcttaagaatacgctgttcgccatgatactgccttacatcgcgttccggcttccggtatcgatcatgctgatccggtcgtttttcgtcgggatatccaaggaactggaggaggcggccactatcgacggggccacgctgatgcagatttacggacacatatacttaccgctgtccaaaccgatcatctcaacggtcatcatcatgacagcgtattacgcgtggaacgagttcgtatttgccacgatctttgtggacagctcgaagcttcgcaccattccggtaggactgatggtgttccgtgacggactcatgacggaatggggcgtcgtattagcaggtatggtcatctcctgtcttccgattatcgttctcttcctgctgatgcagaagagctttgtaaggggcatgaccgccggtgcagtgaaaggataaaggaaatgaagttaattgcaattggagataatgtaacggactgctatatggatgagggcgtctattttccggggggcaatgccgtcaatgtagcggtaaactgtaagagaaatggtgcagagcgcgttaattatatcggtgtatttggggatgatgagcgggcggattacatcagggagtgcctgacaaaagagggcgtgaccttcgaccggtcgagaaaggtgtacgcccacacggcacagccgcgggtatacctaaaagacggagaccgcgtcttcgctgcggggctgcgcgacagctgccagcacttgtttgccatgaaaatcgtgccggaggacatggagattatcaaagagtatgatatctgccattccagctgttactccaatctggagtatgagcttccgacgctaaaggacatatgtgaagtatccttcgatttctcagataagcgggatgaggcgtatttgcagcggacgtgtccgtatctgacgtacgcatttttctcaggttccgacctggaggaggacgcatgtatcgccctgatgaggaaggttcatgaactggggaccaaaatcgtgggagttacgagaggccataaaggcgccgtcttctatgacggagaacgggtctggcaccaggggattaagaaggtggacgccatcgataccatgggggcgggagacagttttatcgcgggatttttaaccgcgtacggagacgggaaaggaatggaggaggcacttgactatgccgccgaccgttctgccgccacatgcatgattcggggaggcttcggctaccctcataaaatggaataaaaatgcagattaaatccgcttccccgggctctcagggaagcgggttttcgggttaaaaaggttgccttgaccgattttgtgagatataattgtaaatgggcattaaggatgaagaagaggacaggagacgcagatatgctaaatcagaatgcattgactccattatatgagcagcttaagaacgcaattaaagatgatatacacgcacagatctacaggccgggagaccggatgccgagtgaggcagagctggaagaaaagtatcaggtgagcaggattacggttcgcagagcggtgaaggagttatgcgaggaagagattctggtccggaagcagggaaaagggacatttgtactgagtaccggagtgcagagccggatcgaccagctggccggatttcatgattccatggagagccagggaagaacggttcggacggagatactggagaaatccattattttcgtgaagccatcctatgcgaatgacctgcagatctcggtggatgacaaggtggtgtatttaaagcgtgtcatgtatgcggacgatatccccatgatgctggatatgtgttacattccgcttaagcgcttcccggggatatttgagaaaatggaaggcaacgtctcggtatttcagcttctgcgccaggagtatcacgctaaactggaccgctactacaaggtgctcaaggtgagaaaggcctccagggaattctctgaatatttgaaatgcggattgggtgatccgctgttcgatatttttaagatcacctacaacgaggagggcgtggcccagcatatttccatcagtattttaaagggggagaatacctcctatgtaatttctaacagcgagaatgaccagatgacccatagtgggatcagctggcgggtgtagccggaggtacgatttatgcgtttgcattgtttggagtgttcttattcgcggtgattaccggatggggacggacgatggagacggagagtggcggaaagaagtagaattgtattcttgagagagttaccataagtccgtaaatactggaatatcccgtatttacggacattttttaacggattatatttttagaacatttctgaacccaacttgatgttggcaaacttctgatttaatgaagccatatatgtgctctgaataaggctggccgggagagtaacgccattccattccaaatctttagttgcacagccatctgatatcagtgtaattttatagccataatctttggcagctcttatcgttgtgtcaatacacatatgtgtcatcattccacaaacaaccagttctgtgatttcattctccaccagtttgttttgcaaatttgtttcataaaaactatttggctcatgcttaacaataaccgtttctgtaaccagtggtttaatatcatgatgaatttgtacaccatctgtatttggattaaaaaatgttccctgtaaagactcatgacgaatgtaaataaccggcagattctgcttcctgaaattttctaataaatcttttatcgtattcaacgctgcctctggtttatacaacgggcattttccattaggaaaataatcattttgcacatcaataataagtaatgcttttttcatagtctcatatcctttcctgattctaatgaaatgatatcggataatagcttctatgtaaattacttactttttcgtacgtatggcaggggttcataacaaattcctttttcatcaaggatttctgtcataccatgcccgaccatgtagtctataccaatttcctgcattattttaattgcggacagcatcttttccccctgcccggttaaaaaatattccacttttagaggatatccatcatacgtttttttatcaattaatccaaagtgtttcaattcacgcagttgttccaacagcattttttgggtaattccggctatactgtgatggagttcagaaaaagaacattttccatttctaagttgaaaaataatgatcgttttccattttccctttatcatatcatgaacaagctctaaggggcatgtgtagctttctctaagtttcatttcatcatctcctgtgtgcgatatcttacattaataggtctatccttcaaaaaggggctgtaaaaaaacagccttaaagaaaaatcgctgaggtcgtgagacttcagcgatttattggtatgattaattatacgactaactactataaccaatgataattatacaccacgtcagttgaaattgctattggaaatcgaaaaattatgaggggagaaaaacttaattctaagagtaatcctcatagccttattaagtgcacacttttttaccaggaaaagcaataattacggcaaataatgtataataaaatgaagaatcgccagaaccggcatttaccggaactggcgattcttcattaaggacttattttacagcccctttttagtccagttcggggccagtatgggcatcaaagctgtattggccgctggaaccgatgaggcgcatgtagctcttgataaagcctttcatggattcctccagtgcctcatttaactccatgtactggatatcggggtcttccttcagggtcctaagcaggctttccttggcgtgattcatgaggtcggtacatacattaatcttgttaatgccgcaggctactgctttggatatattctcggcgccggccccgctgcctccgtgaagaaccagcggaacagtaagggcgctctttaattcttttaggcggtcaaagtcaagcctgggaattctgtttttgggatagctgccatgcgcggttccgatggctacggcgagacagtcgcagccggtccgccagacgaattctttcgcctgggcaacatcggtatagtaatcggtatttaagccgtctccgtcggctgcggtgcctacgtggccgagttccgcctccacggagataccttttgcgtgagcgagagatgcgacggcgctgacgcggcggatattctcttcaaaatcgtaactggaggcatctatcattacgctggaatagccgcacctaatcgcctgtgtaatatcttccatatttacaccgtggtcaatatttaatgcgatggggacacaaacctgctccgccatatgcttgaccatgggcgccatgatctgtgggtaggcatgcgctatcatctgcctcggtgagatattcaaaatcacggcagaatgctcctccacggcgctttcgatgcaggccttaacctgttccatatttactacgttgactgccataacggcatattgatgatctctggcatgcagaagcatgtccttcatggatgtatacatagatgtacctcgtttatgatgtcttgtcagtaagcggccgtttcagaattgcgtacagcactccggtaatacagcttcccaacagccacaggccaataaaaagcagcgggttggaggtcatggcgatgacaaaggcgccgccgtgtactgcaggagattccagtgcggttaccatacagaggccaccagttactgcgccgcctatcatgcaggaggcgatgacgcgtaccggatcattgactaagaatgggataacggcctcttcgatgtaacagaaggacagaaggaatgcagatttcgcattttcccggtcgatatcgtcaaatttcttctttccgcccagcagagtggcaatagcaatacccatgggagcagtcattccggagcacatcttggcagatgtaggaataaagaaaccatcagcatttaaaccgtttgtgaacatggcagcggcttttccgatggggcctcccatgtcgaaacacatcatcgcgccgatgacggctcccataataaatttagagccagtgtttaagctgatcagccagttttgcagggctcccatgcaccaactgatggggcggccgagaatataatacatgatcaaaccgcagatcagagtcgtgcagaccggaattaccagaatgggcatgatcccctggaggtttttgtggactggtatctttttaaaagcaagaactacgtagccaaccaggatacctccgagaaggccgccgacgaaaccggtatttatggtattggccagtgcacccatagcgaggccgggtgctattcctggtttgtcagccatcgcataggcggtgaacgcggccacggccggaacggtaaactgccacaggctggaaccaattagatagattactttggcaaatgtatcaatgttcgccatctcggcgccgatgttgtaaccgccgagcattttagcgatagcctgcagtactccgccgccaacgattaccgggatcatataagagatgccagtcatgaaggaatccttaataaaggctccggtgcttttcttctttgcattttttctcttgagctctgccatattattccaacgcctccatcagttctgatacgatgccgtcaggatcttttacagcctcctggaccgctacggtcatagtcgggatatccttgaaacgttcaacattcttaattcggatatcactggcgatcaatgcggcgtccgctcttgtcaaatcttcctctgtgatctcgttttcaagtccctgtgcgccctgtgtttctacctttacttcgtgcccggcatgtttgaatgccttctccagatttgctgccgccatataagtgtgggcgatacccaccgggcaggctgttacgcatacaatgtacatacattataccccctttgtgattagtaaattttttatatcttcaatggaggaggcttcaagaagaccatctctgaagctgtcatccattaaatttcttgcaagtgtggaaagcatggttaagtgtgagttgtcgttgtcatccggagcagccagcataatgacaagtgtgacaggctcgttatcaaaggagccccagtcgagttcgcctttgagcttaaccatacagaaggaagcttcctttactacgctgctcttacagtggggaatagcgacatgcattccgattccggtagcaaattccttttcccgtgccagtatcccttctatatatctttctctgtcagttactttacctgcttcgtaaaacagggaagcaattctacagatggcgtcttcttttgattctgctttaaaatcaaatcggaccagccgttcatccagcatattgatcagttccatatccatgattcatttcctccgaaaaccgttttgtttgattcctggtttgtttgtgctttaaggataacagggaaaatgaacaataacaaatcaattaattgcactaatatagggaaaatttaaaatatcaattactaaatctgaaaaatagagtaaaatagacaataaaatcatgaagataggtggggaaatgatcaaaaaataatagtatgtgcggcgttggtgcaatttattgattattgattcgggacaaaaacctttataataagcttaccagaaaaatagaataagaagggaagcagataatatggaagattttgagttttatacgccgacgaaagtaatatttggaaagaatgcagaactgcagattggcagagagatcgcctccagaggatataaaaaggtactggtgcatttcggcggaacttatttatgtgagacgggagagatagacaaaatacacaggagcctggaagatgcgggactttcctatgtcgatctgggaggcgtggtaccgaatccgagactgtctctggcaaaggaaggagttgacctctgtaaaaaagaagaagttgatttcattctgggagtgggaggcggaagcgccatagactcatcaaaggcaatcgcctatggtcttgtcaacgattttccgttggaggatctgttcttaggaaaggaaaaaaccgacaaaattgcaccgatcggctgtataacaacgatagcagcgactggatcggagaccagtaattctacggttgtaaccattgagacgcaggaccagggaattttaaagaggtcgtataaccatgactgtgcaaggcccttgtttgccgctatgaatccggagcttacctatacacttccggtataccagacggcaagcggtgcggctgatataatgatgcatacaatggaacgttatattactcaggcaaagaacgtggaactatccgaccggatctcggaaggtcttctggtgactgttcgggaggcggctttaaaagcactgactgatccaaaggattatgaggcaagagccaatctgatgtgggcaggcagtctttcccacaatgggctgacgggaacgggacgtatcaacgatttccccgtacataaaatcggccatgaactcagtgcaatgtttgatgcaacgcatggtgcaagcctgaccgccacctggtcggcctgggcaaaggtggtgtataagagtaatccggctcgttttgcccgttttgcggtaaaagtattcggcgtggaaatgaatttcgatgatatggagaaaactgcacttgctggaattgaggcatgggatgagtggtgcaggaagatcggaatgcccaccagcatcacagacctgttaggaaaaacaccatccgaagcacagatggaggagatggctgagaaggcggccgctaccggaggcggaaccattggtctgttccacagactgacgaaagaagatctggttgacatctataaaaaagcattgtaattaataaaataagtaacgcattgggggaagccgtaaggggagtatttttaacggacatagaaatgagcatggcgaggagagggaatgaatgttgctgcctagagagaaaaagatgatcgaattaatatacagaagcaagaacggcctgacgacatttgagctggcgaatgcattaaatatcagccagcgaacggtgaagtacgagcttcaaaaaataaaggaggagctgaaatcgtctggctgtcggattgacagcaagacgggcagaggaatctggatttcatgcagcgaggaaggcaagaaatttctggacaatctgctgctgaatgaagaagcaccatgttcgttcattccggaggtacggaagtattatattgcactgaaactcctggattcggatgattttatctcgatggaatcaatttcacagaccatgtttgtcagcaacgggacaatcatgaatgatatgaataagctggagaccttttttcagaagcaggggcttgaactggagcgaaaagtaaaatacggagtacgggtccggggaaccgaggagctgatccgggtcgccaaggcgaatgtaatccgctcaatcattgcttctcagggaaatgatgtttcgttgaagctgcagccgttttttgatgatattgatttaagcagcctgaatggaattctacaggagagcgaagagaaattcagctttgtactgacggatgcctcctattcagagatgctgcttcatctcgctattatcatcaagcgattgatgaagaaaaagaactgtatgattgatgaagaaaaccttctggagtaccggaagaaagaagagtgggagacctgctgttttctgggtgagcgggtacaggaagtgtttggagtggaagtatcaaacggggatatcgtttatatctgtatgaatctctctgccgcaaagctgcttcgtgaagccctggttttttctcatgagtcagaacaggctggagaagtatcgtcgcagacctttgaggcgtgggagcggattgtcggatcagtaggcgagatgtatggggaaaatcttcttgatgacaacatgtttaaaaccgctctgtttgtgcacttaaatgccatgttcaaccgcttgcgcaataagatttatatcgaaaaccctttaaaggatatggtgaaggaagaactggcatatgaatttgatgtcgctacctatatggcggggctgttttatgcggagtacggaattaagctgggagagaatgagatctgtgatatcgcgctgtatatcggggcgagccttcagcgggagcaggctcagagaaaagtggaacagccaagagtcatgattgtatgcagtactggtgtggggacgtcacaattcgtggtaacgaagcttaagctgtattttccagatatgattatcaccaaaatcgttccggccaccagggctgaggcagtagccagacaggaaccccttgattttgtgatttctacagtgccgcttaagctggagggcgtcaatgtgattcctgtatcaccacttttgacagagcatgatattaacaaaataaaaatggcgatccatgtgtcgccggctgagcctgtaaggcggggaaacgaaaaatatgcgacactgtttaagctgatggacggacgaatatccatcctgaaatgcgactgccgttcaaaggaagaggcgatccggcttctcggtggaaggctgcaccaggagggatatgtggatgaagaatttgtcgattcggtattcatgagagagaacctggcggccacatcgatcggctgcacgtttgcgattccccatgcttatgagggccatataaagaagcagggaattggcctgatgacattaaaacatccgatcttatggggcggagaagaaaaagtacagattatcatgatgctgtctattgatgtgaagctgaatgagtcattcaaggtgatattcggagaactggcggacctcacaaaggatatgacagcggtagaccggattttgaaagcggacagattcagcgatatttccaggttttttcaataatgattactgaggtaagagtatggaggttacaaaaaaaagatggggttatctggccttggccgtgacgattctgctttttgcaggcattggctacgcgttttcgctgtttgtggcggcgattgagacggacctttccctttccagggcagatacctctttcatatttacactttgctttatctgttttgcggcgggatctctgatcacgggttttctgctgcagaagttttcagcggccctattgcttcgaattggggctgtgatgattttgtttggatttttcacatcctctaaggcagtacagctatggcagctctattttacatacagtatctgctgcggactgtcgatcgggatcgcgtataatattatgatcagcgttattccgctgtattttcaggataaggttggtctggcgacagggattcttctgatgggatttgcgatgagtactacacttttaggcccgttttgtgagaagggattgtccgtgatgggctggagaggcgtatttttgatccttggaatctgtgaagcggcggtatttctggcggggagtgtcggaatccatatgccattaaagaaccagaaagaggggctgccggaggcacagaagacacggagaagcagagaatcgctgccaccgcgccgaatgctccgccggaaatcgttttatgtgttccttaccatttacatagcaataggcggggtgggaatgtcactgatcaaccacggtgcgatgacgcttcaggaggacttgggcagatcactgactgtaagcgttctgattgtaggaatcgtatgcctgttcaatggagtggggcgtgttctgtggggaatcgtttatgacagcattgggagcgcccggtctcttacgtatctggggatattgctgatggcagcaatggtgctggtaattagctctctgtttttagagacggcatggttgttcgggctggggatggcgcttgtcatgttctgttatggaggaagttccagcctggctcccattattgtgagagcgctttacggggattcctgcttttcggccaattttgcagttacaaatatcggcacgatgattctctccagtgtaccagcactgattggaatcatgcagaccaaatccggaaattatacaataccttatgtgctgctgggagttttttcggctgctgcatttctgatggcctgcgtttatgggaaagttacagagtctgaatttggtcacgtatgctgaccttgccagtaatggaaaaggtactggcaaaaagcaggcagaaaactgcagacagtatgagggtgtggacatttaaagttgtccgcatcctcatactgtctgtattttttacgatttctcgattctctccgccagaaaccgtttcgcatcttccccaggcatcggcttcgcatagtaatatccctgaatccagtcgcagcagcattcctcggcgaatgccctctgctcgtctgtctccacaccttccgacacgacccgcatgcccagttcgtgaacggagcgggccaggctcttcatcatgatggccgttttctggtccttctgagccgcccacagcaggctcttgtccagtttgatcacatccacatccatgctcagcacagagacgaggttgcagtagccggttccaaagtcgtccagactgacttccacgccctttgcgtgcatcagatcgataaattcttccagctcctggcggctttccgcgagaacgctctctgtgatctcgatcttgatcatccggtagggaatcccgtggctttcgatgatggagatcaccttttctgccggattatgctgcgaaaactgtacgccggagaaattgacggtgacgctttccagcatcgtgattccactgtctaaaaggtcgtgcacgaagcggcagaccgtatccagcacatagtatgtaatatccacgatcagtccggtctcctcggctatgggaataaattccgagggatataaggggccgagcggggtggcaggcaggcgcagaagcgattccgccagggtaaagcactgcttttccacagaccagatgggctggtaatacacttgaaaaccgccctgggccagggcatccttcaggacatcgatcaccttaaaacgccgtttgacatggtccagcatacccgggccgcagtagcagatgttgccgtttttaccgtctttggcaacggaaaccgtgtattccagcgcgttgattaagtcctcgatcgtatccgcgcttttcggataggtggtgacggcaattaccgttccgatcatacatcggaagtcacggcttttccatggctggttgaagcgtccgtctatggctttgaccagccggatgacggtctccttatcggattccggaatcagtacggcgaattcatctccgttgtaacggtaaagctgatacggcttcaccgtgttgctcaagtaattgcagacggtttttaagaactcgtcgccgttctgctggccgtaggtgtcattcacctgtttgaagtttcgaagggaaacgaggagtatggtgaaggaggcatccttgtggcgtttgatctgaagctggagggagtttaaaaattccttatggttgggaatccccagcagatagtcaatggaaatctgtttgttctgcagatacagataaaggatcagcagtgcgcaggtggcggcggaaccggagagaatgacctccggaaatagctgctggatgatgacgaccagggccgcgatcagcgggaaacacgccaaaatattgcggatcgtgggatccacccgttttcccagtgccacgaccgtgacgcaggtgaacaggcagtaaatatagaagacgaggtaagtggtgatgatgagaggcccctgctcataccgggcctccaggcttaaagaaaacaggcagccggtaaagggattggagatgaccatgagcagatagactgcagccggaagcagcaaaaaaagccacctcttcggaaaacgcggctgattttcatagagtatggagagcgcataatagaaatagatgacgcccataagcggagtggcgataaagtagatggtcgtgaccggccagttcacccacagcggaatcactccggtattctgaatacagatcgtcgataaaatgttcgacgtcatagccagaaacgtcgttaagaaacagacctgaaacagtttgtttttcagtgtcggcaatgaatggctctgcctggagtagttccagatgatgcagagcatgacggttgatatgcattcagcagcaatattccagctcacaatttttttcctcaattcccccaaagtgtacttgttcttatcttatcatgatgggatgaagcgcgcaagcggtaaatgcgcgcatttatgaccgaaaattgacatccccaatccattgtgatataataactgcgtttcagcaaaggagaattatcatgaacttttatttgacaagccagcttaaaaggaaactgaactctgtacaatccataccggtgaaacattgtgcagagtatagcgtataaatgacgtattgagatttcatcgggaaacagggcaatatccatacctgacaggtatgggtactgtctgttttccgtatgggaatctgacggatcagaggctatggacaatgttttgtccgtagccttttgtgttttataagctcttttcgagcttacaggcagaaggctgctgcatcggcggatgcggaattgccttctgcttttttgcgtttttacgcgggataactgaatttataacagagaagaaaggaaataaaagctatgagcttattggaaataaacggattgacacatgcgtttggagataacctgctctataaaaatgcggagctgacactgaacaaaggagagcacatcggcatcgtcggaaggaacggaaccggaaagagcaccctgatcaaaatatgcaccgggcaggtgataccggatgccgggcggatcgtctggcagcccagactttctgtcggctatctggatcagtacgcggagatggatcacagtctgacgatgagggagtttttaaagtcggcatttaaacggatgtacgagatggaaggtgagataaccgcactgtacgagagggccgcggagggggacacaggcttactggggcgggcggcccggcttcaggaggaactggaaacccttgatttctattccatcgacacccgcatcgaacaggtggcaaacggtctgggactgtccgctataggccttgaccgttccatcggacagatgagcggcggacagcgggcaaaggtgattttagcgaagcttctgctggaacagccggaggtcctgctgtttgatgaaccgaccaacttcctggaccgggaacacgtcgcctggctggccggctacttatccggcctggagcatgcattcctggttgtgtcccacgattacggctttctggataaaatcgcaaaccgcatctgcgatatcgacaacggcacgatcacgaagtattatggcatctattccgaatttctgaaaaagaagactctgctgcgggaagattacgtccggcagtatgcggcacagcagagagagattaaagagaccgaggagtttatccggaaaaatattgccggtcggaagtccagaatggcgagaggccgtcaaaaacagctggaccgcatggaaaagatggagaaaatggacagaaaggagataaagccgctcttccatttcccggaactgccgctgaccaatacggagcatctggcggtgagacacttggccgtcggataccagtatccggtgctgtctaacctggatttcagcattggaggcggtcagaaggtggctattacgggctttaacggaattggaaaatcaacgctgctgaagacactgacaggccagcttccctccctgcggggcagttataaattctccgatcaggtggtgcccggatattttgaacaggagcttaagtggaacgacaaaacgatgacgcccatggggcttatatcagatgccagaccggattttgcagggaaggaagtccggaaaaatctggcccggtgcggcatctccagcgaacatgccatgcagcccattggaaccttgagcggcggagaacaggcaaaagtaaagatgtgcctgctgacgctgaaaccgtgcaatttcctgattctggatgagccgaccaaccacctggatgtcctggcgaaggaggcgcttaaggaggccttggccgaattcccggggactgtcctgctggtttcacacgaggaggtattttaccgggatctggtgcagcgggtgattgagatcggaaaagggtgaaacctgtccgaaacttaaaaaaatcatccctattttctataaaatgactatatcgttttgcgtggaatttcggtaaaatggaaactaagattttacgaatatggttatcaagattttatgaataaggagagtgcgatgaaaacaagggaagaagtgaaaacgcttctggaaagtctgagcctggaggaaaaggtggcgcagatgatgcagctgacaggtaattattttgaagggagcaacgtcataaccggaccgaagctgcagatggatctgtccgacgagatgatccgggggacggggtccatcttaaatgtcacaggcggggacactctttacgaggtgcagaagaagtatctggagaacagcgccaacaagatccccatgctgtttatggcggatgtgatcaatgggtttcgaaccgtattccctgttccgctggcccagggctgcagttttaatccggagctggtaaaagagtgtgcctcggtgtctgccagggagagtgcggcggccggactccatgtgacattttccccgatggcggacttgtgccgcgatgcgaggtggggacgcgtcatggaatctacgggcgaggatgtgtggctgaaccgtcagatgacacgcgccatggtggaaggctaccagggccaggatctggaggcagaggggacggtagccgcctgcgtcaaacactttgcggcttacggcgctccggaagcggggagagagtacaacagcgtggatatgtcggagaagaggctcagagaggagtaccttccggcgtataaagaagcggtggatgcgggcgcaggccttgtgatgacctctttcaacacggtaaacggcattccggccacggcaaaccggtggctgaaccgccgaatcctgcgcgaggaatggaactttgacggcgtcctcatctccgactactccgcaatttacgagctcctgatgcacggagtggcggagaccgtggaggaagcggcagaactgggaatccgggccggtgtcgatatggatatggtatccccggcctacggcgaaaatctggtgaatttagtgcggcagggccgggtggaggaaacgctggtggatgagtgcgccctccggattctggagcttaagaaccgtctcggacttttggataatccttaccggtttgatgaggagacgagacggcggcagcaggagtgcatggggtgcccggatcacagggcggcggccaggaagctggcgggtgaatccatggtcctgttaaagaatgacggagtgcttcctctgaaggcagggaaatcagacagcaaaatcgcgctgatcggtccttttgcggacagccgtctgctctgcggaagctggtccatgttctatgagatggaggatgtggtaaccgtgaaggaaggacttgcggatcgcttcggagccgaacggatcgtcacggcgcctggctgctgtattctcgatcgggatcaggagtttctgccgtttaaggggacgaagctttccggcgcgaaggagcgggaggacctggggaaccggagtgatgaggagcttttagaggaggccgcgtctctggcggcagaggcggatacggtgattctgaccctgggagagcatccgcagcagagcggagagggaggagcgagaaccgatctgacgcttccggcgtgccagttgaggcttcttgagacggtctgccagagctgtaaaaatgtggtggtcctgctgttttccggacggccgctggctgtgaaagaggcagcggaacgggcctccgccattctggcggtctggtttccgggaaccgagggcgggaacgctgcagccgacattctgtcgggggacgtgaatccctccggccgcctggccatgagctttccgtactgtaccggccaggagccgctctgctacagccatctccccaccggccggccttccgtgaagggcagtgagaaccgttttaccagcgcttatctcgacgcaccggtggaaccgctgttcccgtttggatatgggctcagttatactgaattcagataccgggatgtccgtgtgagcagcagccggatagagaccggcggagaggtgaccgtccgcggcatggtaaagaataccggaggccgtgcgggggcggagaccgtgctttgctacgtacaggacgcggccggttccacggcacggcctgtaaaagagctgaagggatttcagaagcttgatctggaaccgggagaggaaaaagaattctcctttgtgatccgggaagaggaactgagattcttcacagcggaaggcgaatacgcgacggagccggggctgtaccggatctatgtaggagactcggtaaccgagatgtacagagcagagtaaaatagtatagaaacagacgcgaacacagacgcaggcacaaacacaaacacaggcacaaacacaatgcggcggtcagcccggcaggagaatatccttccggaatggccgctgcatctgctttttctgtggacagagacagcgaatattatagattttgtgaatcccgtaaaaaaatatgaatgtacaccccggccttttttcggtaagatgttaagtgggaaagtgtcatggggcactgccaatttcatgcggggaggaacgaataatgatatataagaagaggggcgtctatctgaagctgtatggttcctatattctgattttattgcttccgcttttcgtcggagccatcgtctacgcacagacgctgaaggccagccaggcacaggcggagcggttgaacaacagcctgatgcagatcgtcaaaaatgagtgtgacaaccaggtcaacgaggccatccgaaatttaaaccggatcgcgttcgatacccgggtccagatgctctccaatgagaagggaaagttcagcgcagaggaccagtacgatatgtacgcgctctacatggacttaaaaaacagcaatttttccgcacagtcctataaggatgtgtttgtgtactttaaaaatacggatacggtggtcagcacatcgggaaacatgtcgctggagctcttttaccacctctattatgaaaatgaagagtttccatttcctgagatggagacgtatctgtcacaatttcatttccaggatattataccgatccgcagcggcaatgggaacagggagcttctgtttaccctgacgagtctgaattccgatctgggtgaaccgtccgccacgatcggcatccgcatgggcgcagatgtgctggaccggagaattgcgtcggcaaaatgggacgagcagatgcagttcctgattctggacagccgaaaccagatcctcaataccattgacgaggcaatgatcacggaccggattcagtacgataaactggaggcgggaaccgattttcagtatgacttgaacggggaacgttacaccggcctcgtcatggagtcccaggcggcaaaatggaaatacgtgcttttaactcctgcgcggatcatcgaacagagtgccagggagatccggaaatactgtgtgatcggcctgttcctgtgcatctttctgggatttgccgtttcgtattatctgacgaataaaaattacaatccgctgaaggcgctggttgatttatttaaagggcagcagaaaaatgatacgtctgacagcaccgcggctgcgccggtcaatgaataccagtggctggagctgcaggttcagagcttctttaaggaacacagcgatattaagcataatttgacggaaaaccagaagattcttcgccagtactatttgttccgtcttctggagtatccgctggaggaagcggggaaggcggtggagcattacgtgccgcggctgaccgattcccatcacatcgtgctgctgttctccatcgaggggatggaagccggagaacaggccgaggaggaggcggggcttcgccgctttatcgtcatgaacattgccggggagattctgggagaacattttaatgtggaactggtggaaatcggtgagatggccgccgccgtggccggccttccgggagaggaagagggctatctcgattccatccgggagtgtatcgagagtatgagaaagatgatcagagagcagttccattttcaggtggtggctctggccggggacgttcacaaggggctggaaggcatccatccctcctatcaggaggcgagggaggcggaggagtacgtctctcttctggagacagacacgatcttttaccgggacattaaaaatgccaataaaaagtactattatcccatggaaatggaaaataaaatcatcaacgccataaaggccggggacagcagacaggccgcggagcttatgggtcaggtgctggatgtgaactattacgaaaacaaagcttcctccggcgtcttcaaatgccttctttacgatatgatgggaacgctgatgaagggggccgacgagatcgggtgcggaagcttctttgaacgggaaaatatcagcctgcagatctcgatgaaacagcccctcgaggagaagaaacggcagtttgcggcgataacggagtctctgtgcagggaggcggaagcacggaagggggacggcggcaacgagctgtccgacagaatcatggagtatatcgagagtgaataccacgatcctgacttaaatatctcacagaccggcttccatttcgacatgacgcccgcgtacctttccgccatgttcaagaaacagacgggaaagagccttctcaagtacatcaacaccgtgcgggtggaggcggcgaaggagcttctggcccagggaaccagtgtggtggagaccgccgagaaggtaggctttcgggacagccggacatttatccgcgttttcaaggaatatacgggagttacgccggggcagatgaagaaaatgcagccgtaaaaggggaaaattcgaaaattcgcctatttacagcgaaattgtgaatggatcagccgtggttttgtgtgtctggtacctgttttgtctctgtttttttccagagccgggtgatagactttaggcatgttcagtgatcacggaaacgaaacacacaattgaatatggaggagttatcatgaagagttataaaaaagcagcttccgcttttatggcggcggccatggcggccacaatgctcgcggggtgcggctcgaaaaccgcagatacacagacgaccgcccaggagacgctgccgcagtcggcatcgggggaattttcctatccaatatcatcagatgaggtgctgacgtactggtgcgaattgaatcagaatgtatcggcgaattactccaatcttggagagacgccttttgccagggaactgatgaaagaaacaggtgtaaccatcgatttccagcatccgccggcaaaccagggaaaagagcagttcagccttttgctggcagacggcagccttcctgatttaatggaatatgcgtggatgaattatccgggcggaccggaaaaggccattcaggatggcaatatcatggcgttaaatgaagtatttgaaaagtattgtcccaatgtcatgaagtatctggaggaaaatccggatgtggataagatgatcaagaccgatgacggccactactacgtgttcccgtttgtccgcggagatgaggcgctgtgccataccatcggaccgatgctgcgcgaggactggctggaggagctgggactggaggttcccaccaccatcgacgaatggcacaccgtactgactgcctttaaagaaaagaagggcgcctctgcaccgtttacatgggaatataccatggaggccctgacccaggaaaatccatttgcctatgcatacggagcctgccagacgtattatatcggatccgataaaaaggtgcacttcggagccgtcgaggatggctataagcagtatctgactacatttaaccagtggtacaaggaaggtctgatcgaccaggatttagcgacgctggccctcgatcaggtgagcgcgaagatgaccaatggccagggcggcgcttccatgggatgggcaggaagccgtatgggaacgtggatcacggcggctcagaagacagatcccaactacatgctggtagccgctccctatccgacgctggaaaagggtgcaaagccggagatgggccagatcgacaaccgctatccgaatcagggctgtgtagccataaccaccagctgtaagaacgtggagctggccgcgagactgctggattacgcgtacagcgaggaaggccatatgcttttcaacttcggtattgaaggggaatcctataccatgattgacggttatccaacctacacggatcagatcttaaataatccggagggctggagtgtggcgcagtccctttccgcctatatccgcggcaactacaacggaccgtttgtccaggatatccgttacttagagcagtactatacgctggagaaccagagggagacaccgaccgtatggggcagcagcaatgccgccgcccataaggttcctccgattacaccgaccgcggaggagagtaaggaattctccacgattatgaatgaaatcaacacgtaccgcgacgagatgacgctgaaattcatcttcggaacggagagcctggatcagtttgaccagtacgtaaagacgattgaaaacatggggctgaaccgcgccctggagattcagaatgcggctctggaacgttacaattccagataggaaaaggaatggagtaagaccggcgggggtgccggaaccgttttttcggcaccccttctttttttcactctaaatacagaaaaatggaggaaatcatgaaggagaaaacatttgcccgaagggccagagcggactggaaaaggaaccgcgctctttatctgctggtggtcccggttattatcttttatatcgtgttccactacaagcccatgtatggagccatcattgcatttaaggactatacaccggccctcggcgtgggaggaagcccgtgggtgggactcgacaactttacccgcttctttaccggaccctatttcgggcgcctcttaaagaacacggtgctgctaagtgtttacgagctggccttcggatttccggcgccgatcatccttgcccttctgctgaacgaactgagaaacaggaaattcaagagcctggctcagaccgtttcctacctgccccacttcatctccatgatcgtggtgaccggcatgataacgaattttgccatgaccagcgggttgttcaacgatttgatcgtcttcttcggaggggagcggtctccgcttctgcagaatccgaagctgtaccgtaccatctatgtggcctccagcgtgtggcaggaagcgggctggggctccatcatctatttatccgccctcgccggagtggacagccagctctatgaggcggcctctatcgacggcgcgggaaaatggaaacagctgattcacgtcaccatgccggccatcgctcccacgattatcgtcatgctgatcttgagaatgggcactctgatgagcctgggatatgagaagaccatcctcctctacaatccatccacgtatgagacggccgatatcatttcttcctatatctatcgtgtgggtctgctggatcaggactggagctactccacggccatcggcttattcaactccgtcatcaactgcaccctgctgttaatcaccaataaactgagcaagaagttcagcgacaccagtctctggtaataaggaggaagtatgaaagtaaagcgttcaagaggagagagaatcttctccgtcatgaattacataattttaggcgcggtcattctgctgtgcttctacccggtgtggtatgtcgcggtggcctctgtcagcgacagcagccttctgacccagcacacgggcctgctattcaaaccgctcggctttaatctggatgcgtacgtcaaggttttcaaaaatccgatgatcgtcaagggatactgcaatacgctgtttatcctgatcgtgggcgtcatcctggatattcttatgacatcactgggggcctactttctctccaggaagaatgtcatgttcaagaaaccggtcatgatgtttgtcctgtttaccatgttcttttccggcggtatgattccgttctacttaacgttaaaggatgtccacttaaccaatacgctgtggggcctcatcatcccgtttatgatcaatacgtataatatgatcattctccgcaccgccttcgagagcatcccggagagcctgatcgaggcggcgcagatcgacggcgcgggccacttcaaaatcctgatgcagatcgtgatccccttatccaaggcgatgctggcggttatggtgctgtactacggagtgggaatctggaacgcatggttctggggctccaccatcatcagaaagagggagatgtatccccttcaggtcattctgcgggagattctcatgcagaatgacgtaggctccatgacggccggcgtcagtgtggcggatcaggagtccataggcatgagcatcaagtacgcgacgatcatcgtggccactgtgccaatcctctgtgtctacccgtttctccagaaatattttacaaagggagtcatggtgggagcggtaaaggagtagcggcagatataaaaagatacgtgaaaaggagatatgaaaggagatataaaaccatgaaagaactctatgaaaatgcccttagggaagccatagaaattacagaaaagaatctggacgcctttatcgatacctttccccatgtgagcacgaacaaccggtaccgcggggaggagaatgcgctgtggacttcttccttctatccgggcatgtgctgtctggcgtacgagatcacaggcgatcccgtgttcttaaaacatacggatcaggtattggacagctttgaagagcggatccggaaacgccgccatatcagccacgatatgggatttctctacactctttcctgcgtgtcactctgcaaactgaccggcagccagcgggcgtaccgcctggcccatgaggcggcggatattctggcagagcgctacaacgaaaaggggcgctacatccaggcgtggggggagatgggaatcggctgtcccgacgtgaagatcatcatcgacaccatgttaaatctccctcttctgtactggaccggtgacgagaggaaggctgaaattgcagcaaatcacgcggagacaacggcggacctgctgatccgccccgattacacctcctatcacacatacctgatgaatccggagacaggtgaggcggtctccggtaagacgcaccagggatatgcggatgagtccgtctgggccagagggcaggcgtgggctgtctacggctttgccctttcctgccgttatacgaaaaaggagcgttttttgacgactgcccgggagacggccagggtctttaccgatcatcttcccgcggattcggttccgtactgggattttacctttaccgatgaaaatcccgatatccgcgacacctcggcgggagcgatctttgtatgcggcctgctggagctgtgccgccacgtgggaaaagaggacgcggacgaataccggaagacggcggaacgcgttatggacagtctctgtacccggtataccacgagagacatgccggaatccaacggcgtgctggcggagggcatgtaccaccgcggcgacggagcgggagagtgcgtcatctggggcgattatttctatatggaagcgctggtccgcatgaagaaggagtggaatccatactggtaggaggaacagagtatgaacggaaaaggagtcagcttatgaatgagtattttgaccttttaaaggagtggtgcgaccgcctgttatcccttcaggtgacggaatttcaggaaaaggagttttacggcggcattatgtgcccatcctgcggaagaatacacggaaggtgtgccgatgccatctatcccatgatgaccatggcggatatcacgaaggatgaaaaatacgtgacctgtgcgaaacggcttttccggtggagcgacaacctctaccggaaagagggctgctattataatgataccaacagcgactggaggggaatcacggtatttttcgtcattcagctgggagaggcgctgctggagcatgggcatctgctggatcgcgtgaccgccgatgcgtggcgggaacggcttaacagaacggcagactatctggcggatcacatcgaggagatcggcggaaatatcaattatccggtgacctgcgcccatgcgatggcagtggcctatcaagtcctgggagatccgcgctatcggagtaaggcaggggaactctcccataaggccctggactgctttacggaggatggcctgctctacggggaagggaagaaaagggatgagctaagcccgaagggctgccgtcccgtggacttgggatataatgtagaggagtcccttccgggccttttgtcctgtgctgtcatgatcggagagaaagaggtggagcttgcggcggaaagagccatgaagatccatctggaatttatgctgccggatggagcctgggacaacagctggggaacgcgcaacaataagtggtcctactggggaagccgcacctccgacggctgtcagccgggatacggcctgctggcaaagaaaagtccggagtttgcggaggcggtgcggcgcaatacccggcttttaaaagcgtgcacccacgacggccttctgcacggaggccccatgtttgacagcgcgaaggagccgccctgtgtccaccacaccttctgtcatgcaaaggccctggcggcactcctcgatctcggatgggcagaagaaaccatagagaacggaacggagtccctgccttcggaccggaggtgcggagttaccgaatttccatctgtccatgtgcggctcatcggcagagggccgtggcgggccacggtgtcggattacgatgtggagtacagcgaggagggccatgccacgggaggtgcggtgacgctgctgtggcatgaacggctgggccctgtgttcacgggaaccatggggcgctactcccttgtggaacccaataatatgcagattcccagaaatacggtgccgctctgcctgacgccacgcttagaatatcaggaacacggtatcatttaccggaatatcaatgacaaagcagcggaagtgatttgtgtggaagaaaaggatgaaatcgtggttgtgacgagaggaaccatgaccgattccggtcagcagggggattcccgttttgaaatccgcatccggatcaccgacggtgcgttcaccatggaaccgtggtgtgagagggaggccatcctgtatctgcctctcgtctcccgatccggggagcgggtggaaacggcggcggacggagacggcgtggatatctgccgcggacagggaagccggcttaaggttcgggcatcagggccgctcacggtctcgcaggaccgcctctttaatccggtaggcggcatggaagctgtattatgtcagatgaaagtggatacagaagtctcatatcatggtataataatctcagaatcgttagagaggagaatgagatgaagattataacaaccgatgtagctgccggccgttattttgatgagacagcggcagtgtggaaggaggaaccggaccgggagagcgggctggtcaccatttatccggagaaacagtatcagtcagtcctgggattcggaggcgcatttacgcaggcggccggttacgcgtggtctgctctgaacagcgagcagaggtcggaagcggtgaacgcgtatttttcagcggctgggctgggctaccgtttctgcagaacccatattaacagctgtgacttttcgctgaggaactactgttacgtcgcagatggtgatgaggcgctgtccaccttttccacggactgcgacgaggagtacttactgcccctgatccgtcaggcgaaagaggccgcgggcgaagggctgtgcctgctggcgactccatggagcccgcctccgtttatgaagaccaacggggaaatgaaccatggcggaaaactgaagccggaataccggaacctgtgggcggagtatatcgtccgttacctcatctcctaccgggaaaagggcatccgcgtgggatacgtgtccgttcaaaatgagccgaaggctgttcagacctgggattcctgtgtctacacgccaaaggaggagcgggactttgcccttggatatctgaagccggctcttgaccgggctggcctggacgtaaagattctgctgtgggatcacaataaggaacgtgtctatgagaacgcgaagacgtattttgaaggggattcggaaggaatctggggaatgggctttcactggtacagcggggatcattttgagaatcttcagatggtcagcgaggattacccggagaagtccctgattttcacggagggctgcgtggagtactccagatttgacagaaataacctgcagcagcaggcggagatgtatgcccatgatatgatcggaaactttaaccatggctgcagggcccacatcgactggaacttattcctggatgagaacggcggtccgaaccacgtcggaaattactgcgcggcccctatcatgctccatacaaaggagcatacgatcgaacggcagcccagctactattacatcggccatttcagccgctatgtgaagccaggagccgtgagaatcgggatttccagttacacttcagaggtggaggcgtgctccttcttaaatcccgacggaagcctggcggtcatcctcttaaaccgggaggatcacccggtggaagtggtcctgcgccacaggacgaagacctctgcactggagcttgcgccccacacgatcgtcacagtgacggacgagggagagaagcaatgagtgtgactgtggcggatctgctccgtctctcctccctgcgaaatgcgcgggtggaggcgggcaggggcggcctgtcccgcatcgtggcgtctctgtccgtactggaatacgcggacccggatcagatggtggatgccttcttccgaaatgatgactactacggaagcgaaattgtcataaccggtttcatgaataacccggaggacgaggagcggcagtgtgcggtgacgcagcggctggccgaggccggtgaggtagggctgattctttattacgtcggcctctttatgccgcgcattcccgaggccatgaagcggatcgccgatgcgtatcatttcgtcctgatcgtcatgccggagaaccgtatggatttccgttattccgacgccatcagcgagatcatggaagccatcgtcaaggaccggctgaataatacggcgtttgtcggggagcttctggatcaggtggcgcgcctgccggagcaccagcgctcggtgggaaccatgctcaagatgctgagcgagagaatcatggcttccatactcctgaccgatcagtccttccgtgtcctgaacgaagcggtctggccgctgaaccaggaaaagacgctgagccgattcctgacagagggaaaactgccggagatggggagtgagagaaccgtatgcattgcggactctgagtacgttctggcccgctttcccatcctgcttcacaaagaccgtcacatggagctgtttatctttaaagagggagaaccgctggtggagactgtccggcagcaggttgtggaggccgtgcagctggcggtcaatatctggagcacgcagcacgatgaggtggacgtgacggagctggtccgcgcgatcttaaaggacgaacccatgaagatgcgccggctggccgatatcttccatatcgatgtggcctccatccactccatgatgatctttcacgtggaagaggattggcagaagatgaacggcgtctccgcgcttaaggggctcacaggattactgtcctctttttataagactgtgtttgcagacatctgcgagggggagatggtgatcttcgtggaaggcccccggtctctcggtgaggaaaaggaaatcctgacggctgtccaggcgtacatggagccgtatacggtgtttcacaccattacctgctgcaatcatctggccgacaccgccgcggtgcgggaagcgtttctgctgcaccgggattatattgaagacaccattgcgatctttccggagaaggaggcataccaccttcaggagatcggctttgcgagagactgccgtgagagaatcggaagaggggaggaggcggtgcaggaggccttaaggccgcttgccgccctgcgggacgcgaaggaggagaaggatgccgtcaggacgctggaggtctatctcctggacgcccagtgcagctacttaaagacgggagaactgctctatcttcataagaatacggtgaaataccgcattcagcgtttttccgatattcttggctaccgcatcggtgatttcccggacaccttttccttatactgtgcggtggcggtgaaccggctgctgaccttttgtccaaagtgacaaaaaatacggctgattttcgtttttccaggggattcatttttccgaataaataatttatgatagtagaaaggtcaacgaaagacgttggcctttctgttttttttgcggcgcaggctttgacgtgcaaaagagtggtctttgactgccgaactgttcgttatggcatgcagaaatttaaagataaggagtgtggcggaacatgcgaaagatcggcttgagtgaaattgaagatattgccctgggcgcttccctgctgggagcgggcggaggcggagacccttacataggaaaactggttgccatgggcgcggtaaaggaacgggggccggtgacgcttctggacccggaggagattccggatgacgcgctggtggttcccatcgccatgatgggggcgcctacgattctgggcgagaagggcgttgggggaaaagagtacgaagtgctgtacaacatgatatcccagtattacggtaaaaagatatttgcatttatgccaatagaggcgggcggtgtcaactccatgcttcccatcgcggcggcggccaggctgggacttcccatggtggacgcggatggaatgggccgggcgttcccggagcttcagatggtgacatttaccatggccggcatatcggcgacgcccatggccctggtggatgagaagggaaacagcgtgatctttaacaccatcacgaatcagtggaccgaggaactggcgaggtcggttaccatgagctgcggcggctccgtctcggtctccctctactgtgtggaaggggccattctcaaacagcacgccgtgaagggcatcgtcaccagaagccagaagctgggcgaggccatacgcagggtgaaggagagcacggatctgactccagaggaacgtttcttggagttttccgaagggtaccgtctgttcaagggaaagatcgccgatgtccttcgggagaccaacggcgcctttaacctgggccgcgtcgtcatcgagggaatcggaagcgaccgcggaaaaagggcggaggtggtattccagaacgaaaatctgtctgcctccgtggacggcgtcattctggctaccgtgccggatcttatctgtctggtcgatacggagacctttattccagtgacgacagacgccttaaaatacgggaaacgtgttcttgcagtcgggctcaaatgctttgacgcgtggagaagcgaggcgggccttaagctggtgggaccgcgctattttggaatcgatacggactatgtgccgctggaagatcggattggagggaatgcagatgtataaattaggaattgacgttggaggcaccaatacggatgcggtcctgatcgacagcgaccgaaatgtggtagcggaagtgaagtatccgacttccggcgatatctatgacggcatcctcggcgcggtccgcgcctgcttgaaggcgtccgggatcaaccgggcggagatcagccaggcaatgctgggaaccacccagtgtacgaacgccattgtggagcggaaatccctggccccgatcggcatccttcggatcggcgcccccgctacgctgggaataccgccaatgatagactgggaagaagacatacagaaaatcgccgtggattacgcggttgtgagaggcggcttcgaatacgacggaaaagagctggccccctttgacagggaagcggcggcccgattctttgaagggctgaagggaagggtaaagtccgtggcgatctcctgcgtcttctccacggtgagaaacgaccatgagctggaggcggccgcgctctgccgtgaggtgatgggggaggaggtccacgtgtcggtatccagcgagatcggttccatgggactgatcgaacgggaaaatgccgccatattaaatgccgccctgtacgaggtggcggaacgctttaccaccggatttgcaaaaacgctggaagacgaaggagttacagacgccagagtctacttatcccagaacgacggcacgctcatgaccatggagtatgcgaagaagtatccgatcttaacgatcgcctgcggcccgaccaactccatccggggcgccagctacttaagccatttaaaggatgccatcgtgattgatgtgggaggaaccacaacggatctcggtgtaattttagcgggctttccacgggaatccggcgttgccgtgacgatcggcggcgtccgcacgaatttccgtatgccggatgtgatctccatcggtctcggcggcggttccattgtcaggcagcatgaggatggaaccgtgaccgtaggtccggacagcgtgggctaccggatcaccgagaaagcccttgtattcggcggggataccttgacggccacggatgtggcggtcaagcttaagctggcggatatcggagataagtcgaaggtggaacagctggattatgagacggccaggaaggccatggaggcaatccgttccatggtcgaggacagcatcgacgccatgaaggtatccagtgcggacattgatgtcatcctggtaggaggcggctccatcattatcccggaccagcttgccggaacaaagtccgtggtgaagcctgattatttcggcacagccaatgccatcggctcggccatatccaaggtgagcggcacgctggaacagctgatcaactacgatgagactccgcgtgaggcagcgttaaaccgggcgagggccgaggctgtggaactggccgtggaagccggggccgtccgtgagacagtggaaatcattgaagtggaggatgtgccgctggcatattatccgggaaatacaaaccgggtaaaggtgaaggccgcgggagatttggtatagcggaagcgacaggatgctgaacagcgggaagtgtgagaagccgggaactgcaggaagccgatggaagtgagattgtgatcgccatgttccgcggcctcagctgtgccgagcgccccacctcatgtccggaccagatggctcaggccctggaacagtatctgacaggagccgcgcagccgcaataggaagaaccggccaaacaggcgggagtccactgtaacgtgaactcccgcctgtttgttatcctttcaggatcccccttccgccaggccgaaatacggctccgaaaaagaaatataagaaaatataaaaaaagtgttgacttttgtcggctgctttgatatgatatacctcgccgctgaaaacggcggcaaacttttccaaaaatcttccagctgaaccgctgagaaagttttgaagaaaatgaaaaaagtggttgacaaaaacaaatcactgtgataagatataaaagttgctgctgacacagatcgacagcaaacgcactttgaaaacagaagattgaacagtatgtaaaaccctgaaaattctaataaaacaagccattgtttgatggctttgaatgagaaaattcagaacgaatacaattattgtatacgaaccaaacaacaagtaaaacgggaaataaattagctagttagttgattttgaccccggatcaaacgaatcatttaacatgagagttcgatcctggctcaggatgaacgctggcggcgtgcttaacacatgcaagtcgagcgaagcggtttcgatgaagtttttggatggaattgaaattgacttagcggcggacgggtgagtaacgcgtgggtaacctgccttacactgggggataacagttagaaatgactgctaataccgcataagcgcacagggccgcatggtctggtgcgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcgggggacaaagtccttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaaaacactttaaccggtgtccctcttcggagcaatggagacaggtggtgcatggttgtcgtcagctcgtgtcgtgagatgttgggttaagtcccgcaacgagcgcaacccttatccttagtagccagcacatgatggtgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaagaagaagtaagggttttatatactgttgagtcttgtgtttcaaaggaaggcgaaagccgaagaaaaaagaataaaagaatagaaacatcagagacaaagagattctggtgccgatgcgctcaggggaaacacccgtacccatcccgaacacgatggttaagacttgagcggccgatggtactatgctggagacggcatgggagagcaggtgggtgccagattatctatgggggtgtagctcagttgggagagcacctgccttgcaagcagggggtcaagagttcgaatctctccatctccattcggtatgaagaaggaagccgtcaggcggaatgaagcatgccagcatgtaccttgaaaaccacatattgaatatatctagaaaagttgaagcagatgagaggttcgcaagaacgtcaaacctgtggaaaacgattcaagacatccgaggtgttatatcgtaacagatataaccgaaaaaaattataaactcgttattactgtaacgtacagtgataacaaacctaagaccagagattcaacgctatgaatcttagacgagtagcccgcacccgcaggcgaaaatcgaactggttaagctataaagagcgcagggtggatgccttggcactaagagccgatgaaagacgtgataagctgcgaaaagcttcggggaggagcaaatatcctttgatccggagatatctgaatggggaaacctggctgagcaaacctcagtcggcgtatggtgaatacatagccatacgttgggaacccgctgaactgaaacatctaagtaggcggaggaaaagaaagaaaactcgatttccaaagtagcggcgagcgaaatggaaggagcctaaaccggcgtgcgtgcatgccggggttatggactgctaaaagtgactcgtatggtaacagaacggtcctggaaagaccggccacagagggtgaaagccccgtatgtgaaaccagaagagagcgagcagattccaaagtaccacgagacacgagaaaccttgtgggaattcggggggaccaccccccaaggctaaatactccttagtgaccgatagcgcatagtactgtgaaggaaaggtgaaaaggaccccgggaggggagtgaaaaagaacctgaaaccctgtgtttacaagctgtggaaccacattttaggtggaaccgcgtactttttgtagaacggtccggcgagttgccgggactggcaaggttaagcactcaaggtgtggagccgaagggaaaccaagtcttaatagggcgaaaagctgataccctaaagggtatcaaacagtcagttcaggcagacccgaaaccgggtgatctacccatgtccaggttgaagtttccgtaaaaggaaatggaggaccgaacgcacatccgttgaaaagggtggcgatgaggtgtgggtaggggagaaattccaatcgaacccggagatagctggttctcctcgaaatagctttagggctagcctcgtattagtttagcggaggtagagcactgaattcttaagggggcgtcaaagcttaccaagagatatcaaactccgaatgccgcataaatgatgtacgggagtcagactgcacgagataagttgggtagtcaaaagggaaagagcccagacctacagctaaggtcccaaagtgtgtgttaagtggaaaaggatgtgggatttcaaagacaactaggatgttggctcagaagcagccacacattcaaagagtgcgtaatagctcactagtcgagaggtcctgcgccgaaaatgtccggggctgaaacacaacaccgaagcttaggaattgacgtaagtcaattggtagaggagcattcttaactgcggagaagcgttaccgtaaggaggcgtggagtgttaagaagagagaatgccggaatgagtagcgagatggaggtgggaatcctccaggccgaatatctaaggtttccagagtaaagctgatctgctctgggtaagtcggggcctaaggcgaggtcgaaagacgtagtcgatggacaacaggttgaaattcctgtaccgcgtattatcagaactgtggggacacagaaccgaagccaaacccgggaatgaaaagaccggggcaagcgccggactggttagactggaaaatccgtctaacaacaggaaagcgtgacgcgtaccgaacaaaagtagggaagttggtataggggctgtcaagaaaagccgctattgtgtaatacgtgcccgtaccgtaaaccgacacaggtggatgaggagagaatcctaaggccggcgggagaagcattgttaaggaactcggcaaaatggctccgtaacttcgggataaggagcgcccacgagagtgggccgcagagaataggctcaagcaactgtttagcaaaaacacaggtctatgcaaaaccgaaaggtgaggtatatgggctgacgcctgcccggtgctggaaggttaagaggagaggttagagcaatcgaagctttgaatttaagccccagtaaacggcggccgtaactataacggtcctaaggtagcgaaattccttgtcgggtaagttccgacccgcacgaaaggcgtaatgatttgagcgctgtctcgacaatgcacccggtgaaattgaagtaccagtgaagatgctggttacctgcgccaggacggaaagaccccatggagctttactccagcttgatactgggattcggtgtcgcatgtacaggataggtgggaggcagagaaggtaggacgccagtcttaccggagccattgttgggataccacccttgcgatattgggtttctaacctgcggccatgacctggccgggggacaatgtcaggtggggagtttgactggggcggtcgcctccgaaagtgtatcggaggcgctcaaaggttccctcagaatggttggaaaccattcgaagagtgcaaaggcataagggagcttgactgcgagactgacgggtcgagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggactgacctctggtgtaccggttgggtatcaaacccatggccgggtagccaagtcgggaagggataaacgctgaaggcatctaagcgtgaagcccccctcaagatgagatatcccatcgcaagagtaagaccccttgaagacgacgaggtagatagggcagaggtggaagcatggcaacatgtgtagctgactgtcactaataggtcgagggcttaaccaagttggtttaggttgtcagaaatggcagaggaagtaagaacggatgaaagatatgtacaatgtgtggttttgagggtatatgccctaagaaaaaacggagagatgagagtcgcttcgtttttatagaataagcgcgagtggctcagtggtggagtacaaccttgccaaggttggggtcgcgggttcgatccccgtctcgcgctcttattatgtaagaaaacggatttccagagatggaaatccgtttttgagttacaccccaaagtgtatcatatacttctgttcatcgatcgcctggctgatcttgtctgcaagcgcaatgaggttgtgatcgtgattgattcttttgtcgctgatcacgatatcctgcagtgcggggagagactccggcgggattaaggtaacaccgtatctgtcgagggcaaaggaggggcggctgagggactgtgtgtaggtccggatcaacagcagccgcggccaccagtcattgatatacttgtcgtcatcgatggcaacacagccatacttctgaggttcatatttcacataatttttttctggatcgattgtatccatgattccaaattctgtctttatcataagctcacctgaattctacagcagctcagtgtcccggtggattactcgcagggaacaactgtctcaattaaccggtcggcagtttcttcgtctgcggcgatggagaagagatagaccactttgttgtcctcattacgcaggtagacgttcatctcgaggttctccggtattttacagaccattttctgataagtctggccggccacggtcacgggccgcggggcagtcggagtcagatcgtatttcccccagaatgcagaaaatacattgagatcgtcccccagaatctgctctatcggatcactgttatactgaatgacgacgccaaacagcgactgatcgggagtgacagccaggaaatcgtaatagcttgggatatagtcatgagcggaaagtacattcagttcttcggcggtctgcacaaaggtatattccggcagcgtaatacggattccggcccagggatgctcatagactgaattctcgaaccggccggagggaagatggacgaaaagagggtccgtcatgggcgtctctttccaggctcccgagcgttcgaagctgtaggtatggccttctatgtcgcgcgtggtgtcgctcaccattattccatcggcatcaaagtagtaccagccgtttccatccctgatccagccgccgcgtatcagggtgccgtcagagagcgcatactgccattgatttcccttgtgcagccagccagtgctttgattcctgctggccgtgcttaccgcggcatatgcctcctgcggccggacagccgaaactgtaccggcgagtgccagggacagacataatcctgcggaaatggtaagaagacgttggtttaatctcatgaagctatgatcctcctgtcggtaataccgtcttgcacggtgaattacagtaagtgtatctctttttggattgtctgtcaaatacgaggatgaatgtgctgacgtttaaatttacagaagccgtaatatccgctataatcaggacagaggcagtagcagataagacagcacaccgagacgaaagcgaagaaagataagaccgtgcattaagacgagagaaaagcaaccggacggggctggaaaggggtgggaatgtgagtgaacctgttgcaaagcgccagatgtttgaatatgacggggataatccgtttcatatctataatattccctattatccgtcgagcagtgatgaacttctgtttaatcactggcacgaggaactggagcttgtttatacgctgcaggggaacagtctgcattatattgacgggacctgcattaagtcacagccgggtaggctgatcgtcgtgaactcagaaagcagtcataatatcataccggaccgcacggtatatggaagcggaagaaaagtggtgattgcgctgcttatttcgcgggaatttctggagggggtatttccggactttaaaaacatgtattttctcaatgagaaggagatgacgactccggaaataggggatttgatggtgacactgtcccattacgacgatgaggcggagacgtcatcctatgagcggatttatataaaaggactggtactccagcttctctaccatatcacgcaggagggagtggcggagaaaaatgtgatcctgccgctgaacaatcagaagaacattgagcggctgaaaggcgtcctccagttcattgaaaaccattacatggaaaagctttctcaggcggagatcgcggataagttttacttttccaaagagtatttcgcccgtttcttcaagaagcacacggggatgacctttatcgagtacttgacgaaataccgccttcaaaaggcgcggatgcagttgatggcttctaattccggaattcttgagattgctctcaataatggtttctctgacgaccggagactgattctggcgtttaaggaggagtatggcacaaccccgttccaatatagaaaaatggaaagaaataaagaagaataaagaataatagcggctgcattttcatgtacaggtcaatatatggatgtttttggctaaaatacgcaaggaattcactgtccgtctccgttataatgaggattataaaaatcaagttacaggagaggggaagcaatgggaaaaaagaaaaccggtttatcatggtcggaaaaaatttcttatggtatgggagactgcggagccaatgtgacagtagccctgtgttctacatttttaactgcgtattatacggacactgtggggatcgctgccgccgcggtcggcactatgatgctgctggcgcgcgtgttcgatggtgtcaccgatattgtcatgggggcgattgtcgataaaacgaagacccgctggggcaaggcaaggccatgggtgctgtggacagcgccgcttatggcgatcgctctgatcctggaatttaatgttcccggaggcttaagcgggaatggaaagctggtctatgcgtatctgacctatattttccagaactgtatcgtgtatacagccaacaacctgccgtttaacgcactgctgtcgcgcatgacgctaaatgtacaggaccgtgcctccgcggcgactacgcgtttcgtcatgactcagcttacaacgctgattattaatgcggtgacagcaacccttttgtctacggcgggatggttctggctgtcgattatttacggcatcgtaacattttttatgtgtctcatctgctttctgggtaccagggagcatatcggagaagatgcagaaactggtgtggttcaggtggagaatgttccgctgagtacagcactgccggcacttttcaaaaacaggtatttttatattcagagtctgctgtttatgtttctgtatattggaatcgtcagtaccggttccacaacattctatttttgcaatatcgttttaaataatctgggttacttaacctacatatccatggctactacgattccggccatcatcgtgaatcttatgcttccgaaggccattcagagatacggaaaatggaaactgatgattggcggtgcattcctgatggctctgggcgggctaattatcggtgcggccggttccagtttcccgctggttcttctggggctgatcataaaaggaacgggaatgggaccgatcatgtccggtatctttgcaatgaccgcggatgtcgtggattacggtgaatggaagaccggagtccgctcggaaggactggtcaactgctgtacatccttcgggatgaaggttggaatcggcctcggctctgccctctgcacctggctcattaccatgggcggatatgatgggaccgccgcagtgcagccggcttccgctgttactatgattcggttcgggtttggttacagcggtgcgatcatcgcggtgatctgcctggttctgtgcttcatgatgaatatcgataagtatattgtggcgattcagaatgacctggaagcaaaacggaatataaaatagagaggtacagataactatgtcagaaatgagtgatacaattcgtaaactgtttcgggagggggatgaccggcgggatgccggtctcaccacaccggagggaatccggcgttttgacgatatcgtctatggggaggatgcagagcggcagattctcgatgtataccgtccaaaagataaggcgggggtactcccggttattgtgagcgttcatggcggcggatgggtgtatggtgacaaggagaggtaccagtactactgtatggatctggcatgccgcggattcgcagtcgtaaatttcacctaccgtctcgcaccggaatataagtttccggcgtcgctggaggatacaaaccgggtgtttgcctgggtgctggatcatgcggaggaatatggctttgaccggacgcggatcttcggtgtgggggattccgccggggcccacaatctggggctttatgccgctgtctgcacaaacccggaatatgcggcaaagtatccctttcagccgcctgagagatttgtgccgacggctgttgcactgaactgcggcgtctaccgggcgccggtctctgaagacgagaaggaccagagcaatctgcttatggcggaccttctgccggagagagggacgaaagacgaatacgagaaaatcagccttgtgaattacgtgaccagtcagtatccgccggtgtttctcatgacggctgccggagattttctgagagaacaggcgccgcttctggtggagaagctgatggagtttgagattccgtttgtataccggtattatggcagcgcggaccggcctctgggtcacgtgttccactgcaacatccgcctgcaggaggcttcgcggtgcaacgatgaggaatgcgatttttttcgaagctattgctgattcacagcggccagctgatccagaatagtgagaacttcggagaactcatacatgctgtaatcagccagtgtacggtcaaaatgaaaacggtcgtcgatgagcgcagccacggtcataccggctccgtggccggccatgataccgtaagtggaatcttccacgacgagacattgtgacggtgtacactgcaggacgcctgccgtatgcagatagatttccgattcctgctggtcgatgaggcgagagccagcagatagccccggtcttttatttcttttagaaggccgggtaccatttcttcagacgctgaaacatgtggttcaaatatacgaattcactgtcgatcagaacaccgtccataccaaagatcactgcttttatcatctgagattatcctcctgccctttcctgtcactcttttccggttccgaccggtacattccgatctgtgcctttccggtagcgaccatctctccggcaagcgcgggtgcgtcatggtccagtcccatcctgcatcggatagccagttccagcgccatacccagattaattccatatagaaccgtcagccgagggtctgcatctgtcagcgcggcggcacatttataaggagatccgccgatcatatcgcacagtatgagaagctcgtcacaagtctgcatggctccggctgcatcttttaaatgttccatcaatgtgtcccagctctgcccggattcaaaatccacggcagccagcagctcctgatgtccaatcagcaattccagtgcgctgaccaaaccggaggcaaactgcccatgtcctgtgataatcaatcctgtcatgcgtttctccattcttcttgtatttgccgcagcttttattttataatctcctatatcatatactatatgcaaaaaaaacgcaattccccgtccctttccggatgcagttttccctgttttctccccggttttcagaaatgtcagaaaacctaataatttccatcaaaaacagaattgctatctcttcagtaaaagcttagaataaaatcagaacattctgttaaaaatcgggggattgcagtatgaaaattggaaaaaagatacttctgaccagtgtatccttaattacagccggtattctggcagcgggagggattatcagctcggtttacataagacgtcagctggacagtacgggggtgtatgtggagacgttggttgaccagatcgccgtcaacatcggaacgagaacacgggaatatgaggatacgatgttaaatatggtgcagaactgggatttgttcggcagctatttaaataaaaaggacagcaatatctattacaaccgccgcgccgtggcttccttcgtgaatcagagaaacacatcgaggtcgccaatcctggatttctacgcattggacaacagctcggtgatcacctattatgattataaaacacagagctttaaggatgtgaaccaggagattgcagactatatccgggtcaacagaaaagtaataccgaagggcgccatttggaggtgttttgcctcagagccggaaaaggtctacatgatccggtccatttacagcccggtcaggctggaatatgacggtgtgatcgcggtggggatcagcagggatctatttgaacgtcagtttctggcactggaacagagcaaaaatggaaaggttaccatcctaaacccggagggggaggtgatctttggaaggaacggcgaacaattaaatcctgcgtccattctggagaagagcagagagtccggtgattcccgccaattaatcaggagcggaagcaggagctatctggtccgaaataaggaaaccgaggacaagaagtggaacgtgatctatcttattaacgagcaggagctcttcggtcccatgaatcagatgctggtggcgattctgatcgtctgctctgcgaccatactggcggcggtaatctgcgccgcagtgatctctggcagtattacgaggggaatccgccagctgtatgatcacatccagcgcctcaagcagggggagtggaccacgctctccgtcccctattccaaagatgagatcggccagattaccattgcattcaacgatatggcggtcagcttacaggacatggtggagcatctggccagacagaagctggagacggagcaggcggagtataaggcgcttcaggcggagtacggggcactccaggcgagagtgaatccacattttattttcaatgccatggagtccttaaatgccgttgccaaattaaacggacaggacacaatcgcctccatctgtacgtctctgggacggctgatgcgtgtggccattaaccggagaaagagcactgtgacgcttaaggaggagctcagctatgtcagtgactatctggaggtccagaaattcatgatggaggaccggctggaggtattttttgatgtggaaccgcaggcggaggagtaccaggtgccttctctgcttttacagccgctggtggaaaatgcggtcattcatggggtggagaatttaagtgagggggcagtgatctttgtctcatcggatctgattgccgggccgaagggagaagcggccgtggtgatacagattgcagataacggagcgggaatggacgaggagactctgaaacgatactgcgatttttctgtcagtgcggaggaagacagttccagccatttcggcctggtaagcgtagagaaacggataaaaattctgtacgggcaggagtacggaattacagtgtcgagccaggtggggaaggggaccgtcgtgaaggtagtccttcctgccctcgacagaaacgggggatttacatgattaaaattatggtagtcgatgacaatgctctcgtcctgagggctgtctgcgaaacgattgactgggcggccatgggctgcgaaatcgagggaaggctgacgaatgggatcgagggattccaatatgcgaaggagcatcatccggacatcatcatcaccgatattaaaatgcctggaatggatggcctggagatggttaaggccttgaaagaggagtacgatacgttttcgtccattgtcattaccggtttcgacgagtttcagtatgcgcagcaggcgctgcggctgggggccgcggatattctgctgaagccgattgaaaataaggagctggtggagacggtgaggcggattgccggggggagcatggaggagaggtacggaggagcaggaaaaccgaccggaaatataagcctcaatggaacctgcagcctgaccgaaaatcaaatcctgactgaaatgacccgcaaagagcatatgcagtatctggaagagaagaaggaggagcactacgccattgtggtgcgccgggcgctggcgtatatgcgggaaaacttaagcaggaagatcagtctgacggaactggccgactatgtggggctgtcggcggctcatttaagccggctgatcaaaaaggatacgggaaagagttttattgacgttctcaatcagattcgcctggagacagcggtccagctgctccgtgatggcagatataaggtctatgaggtatccaacatggtgggaatcgacaattatgcgtatttctatcagttctttaaaaaagaaacgggaaaatcaccgacagagtatattcagaacagaacgtaatgcatttatccctgtcaggcgtccgccgggtaatttggtacggcagatagaagacgtcataataactaataaaatatcatttctgttaaattgtttgtgcatgttgaatgatatacaatagtgtcagtgggaaccccaagaacaaagaaaaggagaagagatatgagaaagaaagaaaaaagatgggttagtctggcactggcgtcatgtctggccatcgcggccttgacgggatgcagctcaggatccggaaagaccggagagacgaagagcgctgctcaggcagagacagaagcaaaagcagaggcaaagaaggaggaggacaaagaagagaaaaaggaggagagcaaggacgaaaacaaaggggagaacaaagaggaagtcacactgacatttcttcaccacatgggggaacagggtaagaaagacggactggtagcgctgtcggaagcatttacgaagaagtatccgaacataaagatcgaggtggagttcctttccagagatgattttattaatcagtacaaacagcgggtagcggcggacaatgcgcctgatttcatcaattaccggccatttgagacgccggaggtcatagaggccgggctggtggaaccgctggatccctccattttcccggataatatcgataagaattgtatcgattccatatcactggacggaaaaatctatggaattcctctggacagaggcggatatggcttctattacaacaaaaacatgctggaaaaagcgggagtgaagccggaggatttagatacgatgtcgggagttttagaggcctgccagaagataaaggatgcgggaatggttccgctggcttccggttatgcggaatcctggacagagaatatcatcatcgagggccagacttttacgggaccgatggtcgccgatccgatgatttttgagaaactgatgagcggggaaaagaagttttccgattatccggaatttgtggacattattacgcacggccagcagctggtccgtgattacgcgctggtagatgagaaggcggcaagccagcaggcgtccgaccagtatgcgcagttcggacgcggtgacgcagccatgatgatgcagggaacatgggcgatctccgatatccgaatcgcacagaaggcagcaggcaatacggatgagtttggatttacgtattatccatggtctgacgatcctgcaaagaactatatgccggccaatgccgatgactccttcatgatttcatcggggagcaagcacatggaagaggccatgctgttcgcagagtttgttctgacaccggaggcgggaaaagtatgggccaacgcatcgggctgtatcagcgctctctcgggcgtcagcgcggataatccggatccgcttctcacgatctttacgaaggtcctggacgaaaagggatactattttgagatgaatccgggcctggcgggccagtattaccaggattttgacaagatctatatcgagggaagaattgcggaggattctccggagacggtgatcgaaaagtggcagaaatcatttgacaatatccgggctacagggggctgacgggaattgacgaaaagggagcggccggaaacgcggcggctccctttttcctaaaggaggcgtatgctatgaaaggcagatggaagtctgttaagaaaaacagtattgatttcatgtttttactcccggccgccctggtattccttttcgtcatcgcagtcccgttttttcaggcgttcgggattgcgttcacaaactggaacggtctgtcgaaggagtatgattttgtagggcttaagaacttaaccgccctgtttcacgatacacagacgatcaatgcagtctccaataccatggagtacacggtgattacctgcatcggcgtcaatatcctggcactggccataactgtgggattaaacttaaacgtcgcaggcaaccggttcttgaaaagcgccatgttcctaccgattatagccagcctggtaatcacggcatttatctggcagagaatctatggagatgtatttccggtgaacttcggcattgtaagtccgcttaccaggctgaccacagtgattccgggaattgccctgatgtgtctgtggagggatacggggctggccatggtgatctacaacgccggtattcagtcggtgcccggagacctaaaggaggcggcccgaatcgatggggcaaacgcgtggcagtccttctggaacgtgacatttcccatgctggccccggcctttaccacctgcgtcacactgtggctgggatatgggttaaaagtcttcgactatccgaaggcggcaacgggtgggggaccgggaaaggcgtccgagacgttttccctgttcgtatacaatcatttcttcacgaataacagggccggatacgggcagatggccggcctggtgatgctgatcttcgtggtggtaatcacgggagtggttacaaagctgctgcggaagagggaggtgcagctgtgatgggaaagaaattacatacggcctccggccggcgttttattctgctgagcctggtcatgtggtgtgtgacgattctgtttctggcgccgttttacgtcctgattatctatgcgtttaagccgagggaggcgaccatgcttaagaaccccctcgcatttccggatacgctctatcttcagaattttgtggaggcggtgcagaaatctgatttcctgagggcctttaccaattcgacggtatctaccgtgtgcggtgtcgttgttctggttcttatctgttccatggcggcttatatcgtggtgcggcggggaaacaaccggttttacggagtctggcagtacatattcctggcttccgtcatgctgccgtttcagaccatcatgtttcctctctataagaatctgatgaaccttcatctcttaaacagccgtccggcctatgtgctcgtgtctgtgggatttcagatgggatttgacatcttcctttactgcggctttatcaaaaccgttccggtggagctggaggaagcggcggcgatcgacggatgcagcaggatggggatcttttggagaattgtttttccattattaaagccggttaccatgacggttgtcgtattatcggcgctgggaatctggaatgattatcagatcgccctggttgtggtatccaaggaggcagtgaggacactgcctgtggcgcagcagtcttttatcgggcagcagatctcgtatctgaatctggcgtccgcggcgtgcctcctgtcgattcttcccatgtttttcttattcctgtttttacagaaattcatcgtgcagggagtgaccgcgggggcggttaagggatagatttatcaaaaaggagaagcaaaatgagaatacatagaacggatctgcctggaagggcgcgggaactggcggcagccatacagaaacggtatccgaaggcggatgagtatccataccgttcctggagctatccgcagggctatcttttgatggggtttattcatttatgggagaaaacaggggatgagttatactacgagtatgtgcttacatactgtaaggaccacgtgacggaggacggaagtgtccggggctttacgggatgcagcatggacgacatgatgactggggccgtgctggtctggatgtatgagcagacgggggagaaacggtttgaggcagcatgcagaaagatccgggaaacttaccgggattatccgcggacgagagaaggaggttttcttcataaccgtaccgagtttccgggagaaatgtgggtggacggcgtctttatggggcagatgtttttatgccggtacggagccgtattcggggaaacggagtgttttgacgaggcggtgctgcagctggaactgatttacctgtactgccatgcgcacgacggtcttttggtccacgcctacagtgaggactgtttggctccctgggccgggccggatggcaggtcaggatgtgtctggagcgaggggctggggtggtatgccctgattctgactgaagttctcgatctccttcccgccggttatgagggaaagaggacggtggagaatcagctgaatcagctgctggccggcctggagaaatatcagaatcgggagaacggcctgtggagacaggtggtggaccggaccgatgacgtggataactggtgcgacacctcgggaagcgccatgtttctgtacacctggaaatgggcggcggataagggaatggtgccggaggagacggcggagccggtcttaagaaaaggatacgaagggcttcttgcccgcatcgtcccgggggaagacgggctgcctgatgtccatacggcgtgccaggggctctgcgtccagaactgttatgaggactatatccattatccaaagaccattaatgcacaggaggcggtatgcggctgcctatgggctctggtggcagcgattggctagggtgggtttgaacagaccaatgcattacgggcaaacaaaaaaaggagaagcgtatgaaagcgttaattgtagatggggaaggccgtttatcggtggaagagataagcatgccgcagattggaccatgccaggcgctcgtgaaaatggagagctgcggggtgtgcaacggaacggatcggaagatgattcacaggacatttaagaatttccacacataccccgccatactggggcacgaaggtgtgggaaaagtggtaaaaacgggagaatttgtggaaaaccttcatgtgggcgaccgtgtgctgctcccatttctggaggaggaggccgacggatacgttccgggatggggcgcctatgcggaatactgtgtggtgggagatgagaagagcgccatacgccatgggatgggccctggcacaaaacagtggaacgaagcctatgcggctcagaccgttatccggccggaggatcgggtggatgcggtgggcgcttccatgatcatcacgtttcgggaggtcttaagcgccatccgaaggttcggattccagcctaatgagaccgcggtgatattcggcgcaggtccggtagggctctgctttaccaggtttttaaagctgctgggacttaagacggtgatcaccacggatattctggaggacaaggtggaaaccgcgaggcggatgggggccgattacgcgtttcattctgcctcctgcaatgtgacggaggaggtgaaaaggattttcccggagggcgtggattatgtggtggacgcggtgggcgtcaatgcactgattaaccaggcgatggggctggtgaaatacaacggaaaaatctgctgctacggcatctctcctgaactgtccatgaagctggactggagcagcgccccctataactggacactccagtttgtgcagtggcccagcaagagggaggaaggggaagcccattcccagattatggcgtggattaaccagggggtcctggatcccatggactttatctccgatgtgatcccctttgagcggatcaccgacgcatttgaactgatcgaggcgaagaagccggatacgaagaaaatcgtggttcgattttagaaatggaggagttggaatgagagagagcagactgttttgcacgctgccggagtacgtatgcacacctgacgggatggcagttgaccgccatggaaatctggtgctgtcctgcccgaattacgcggatgacagcatttccggctgtgtggtccggatcgataaagagggccatgtgcgaaagtggttcgacgtaccggtccatccggagaccggggtggccagaaatatggggatcgccttcgatgacgagtggaatctctatctctgcgacaaccagggctggagcgaacgggaagagctgctgtacaagggcagaatcctgaagctcacggtagatgaggaaggaaccatcttaaagaccgtcgtcgtggcggaacacatggagcatcctaacggtatccggatcagaggcgggtacatgtacgtcacacagagctatctgcatccggtcaggaggccggatggaaagctggtgagctgcgtataccggttcggccttgacgaggaaggaattcagatcaccaataccctggaggaccgccatatcttcgccacctttgtgacggagaatccggactgccagtatggcgccgacgggatcgtctttgatcgggaaggacgactctatgtggggaatttcggggacggagccgtttaccggattacgtttaaggaggacggaagcctggacgaaaacacgctgttcgctcgggatccggaggagcttaaaagcacggatggcatgatattcgacgaggaagggaacttgtatatcgcggatttctgtgccaatgcgatcgtgcaggtgacacccggaggaacggtacggcggattgcccagagcccggactgcaaaggcgcggacggaggactggatcagccaggggagccgattgtatgggacggccggattattgcttcctgcttcgaccttgtgacgggaccgggaaaggtgaatttaaaacacgagatgccggctgctctggtgcagctgccgctgtaaggaggcgccatgggacagggaactttaggaaatgcgggagaccgcgggggcacctgtattctggcccacgatctgggaaccagcggaaataaggccacactctaccgcgcggacggaacactggtggccagctgtgtccacgaatatccaacgagttacccgcagccggggtttgtggaacaggacccggaggactggtggaatgcggtctgtgcgtcgacgagagagcttctggaaaaaacagggatgcggccggaaaggatagctgccgtgtccttcagcgcccagatgatgggctgcctgcctgtggaccgggaggggaatcccctgcgcccgatgatcatctgggcagatacgagagcggtggaagaggaacggtggatggtggaacgtatcggtatggagcgcggatatgagattacgggccaccggctcagcgcctcctattccgcggcaaagcttttatgggtgcgccgccgcgagccggacatctatcgccgctgttataagatgctgcatgccaaggatttcatcatctgccgtctgacgggagagttcgtgacggattacagcgacgcgtcgggaacgaatctcttcgatatccgggcgaaaatgtggtccgaagagatcttaagggcactggacctcgatgaagagctgcttccggagctgcatccatcgaccgatatcgccgggggcgtgacgaaagcagccgcagaggccaccggacttttggagggaacgcctgtcgtgatcggaggcggggatggaagctgcgcctgtgtcggggctggtgtggtggatgaggggagtgcctatctggtgctgggatcatcgtcctggatatcgctggcgtcgagggagccgttattcgatcctgagatgcggacatttaactgggttcatctggacccggagctctatactccctgcggtaccatgcaggcggcaggctattcctatcagtggtaccgcaatacgctgtgccgcggagagatggaggaggccgcgaaaacgggagaaagcccttatgagcggatcaacaggggaatcatggaatccacaccgggagcgggcggtcttctatacctgccctatcttctgggggagcgctcaccgcgctggaatccggatgccagaggcgcctttttgggcatgtcggtgacgaccggaaaacatgacttatccagggccgtgctggaaggcgttggtttcaatctgcgggttattttagagagtatgcggcgggaacgagagatgaaggagctgatgctcatcggcggaggtgccaaggggcagacgtggccccggattctctcggatatcttccagatgccattaaaaataccggcataccgggaggaggcaaccagcatgggcgcggcggtgtgcgccggcgtgggcgtgggaatataccgggatttctccgaggcgaaaaggattaacgccatcgtggatacggtgatgccgagggaggaaaaccgtctgcggtacgaccgcctgtatgagatatttaaccatgcgtatgacgctctgacgggagtctatggcgaactgggcgcttatcggaaagagatgggggaagaacatgaataattttatctggtacaatcctacccgcatcctgtttggaaggggaacccataacgaggtggggcgggaaacggctgcttactccaggcggattctgctgctgtatggaggagagagcttaaaggctgcggggacgtacggtgcgatcacaaaatcactgacagaggcgggcgtggaataccgggagctggggggcgtccgtcccaatcccagactgtcgctggtgcatcaggggattttgctgtgcaggcgagaagggctggatttcgtgctggcagcaggaggtggcagcgtgatcgacacggcgaaggccattgcggcaggcgtcttatatccaggcgatgtgtgggatttttaccatacggagaagcggccggagagagtccttcccacgggggtggtcttaaccattccggcggccgggagcgaaagcagtgacggcagcgtgattacgagagaggaggagaatgagaagaagtcgttctgctcaccacttttgtatccgaagtttgccattttaaatccggagctctgttacacgcttccgaaacggcagattgcagcggggagcgccgatatactggcccatgtgatggaacggtatttctctcccaatgggaacacggagctgtcagaccgtctctgtgaggcggccatgaagacgatcatccacaatgcgccgctggcattagcggatccggaccggtacgaggtctgggccgaactcatgtgggcgggaaatgtagcccacaacggactgttgggaaaaggaagggaagaggactgggccagccataacattgagcacgagctgagcgccctctacgacattgcccacggagcggggctggccatcgtatttccggcgtggatgaaggctgtgagcaggagaaatccggcgcgttttgcacagtttgcggaaagggtattcggaatcgaagcggaggataagcgggaggatgagctggccgcgctgggaatcagctgcctggagaatttcttccggagactggggctttttaccacgctcacagaggcaggaatcgatgacagccagttttcacgaatggccgggcgcgcagttgcgggcggcagcctgggaagtatggaaaaactggaccagacggcggtgatggagattctggagctggccaggtaaggaatgaggagggagacagacatgaagataacgccaaaggaactggccgggtattttgatcatacccagctgaaggcctatgcggtacgggccgattttgagaagctgtgcagggagagcagggaatacggattccggatggtagccatcaatccggccccggtggctctgtgcagggagctgctttccggctccgatgtccatgtgggagccgccatcggttttccgctggggcagacgacgatcaacgacaaggccagtgagacgaatgaggccatccgaaacggggccgatgagatcgactacgtcgtaaacctgacgaagctgaaagagaagaactacggatacgtggagcgggagatggcttccatcgtggagacgtgcagggaggcgggagtaatctccaaggtcatctttgaaaactgctatttgacggatcaggagaaggaggcgctctgccggattgccctggaggtgcggcctgattttatcaagacctcgactggctttgggagcggcggcgcaacggcagctgatattatgctgatgaaacggatggtgggagatgcggtgaagataaaggcggcggggggaatccgaacgcttgacacggcgcttgagatgatcggtatgggggtgagccggatcggatcgacggccagtgtttcgatcgtggaggaattgaaagcgcggcagcgcgggtcctgaagtatgtttgtcataacctgaagagactcttataaagactcccggacaggcacacagaaacggtatgcaaaatggtgtacagaaacggccggatgtggtacaatgcaggtatgagttttagcacatacatcgtacacatgcggcctgtttcagccgttttgagtgctcaggacaaggaggaatggtttatggaaagagcgattacaatcagtcgtgaatttggaagcggcgggcgtgaactgggagtgaaactggctgagagtctgggaattccgttttacgataaggaattgatttccatggctgcagaggagagcgacatgtcggaggacgcatttcttcattatgatgagaacatgccgttcataaaagatccgctggaccgccatttctactcgccattttcttccatctatcaggttcccatgtcggatcagatctttttggcgcagtccagggtgatccggaagctggcggatcagggcccctgtgtgatcgttggacggtgcgcggacatggttctggagaatagtgtgaatctgttcatttacgccaggatgaaggaccggatcaaacgtatgaattccctggagacaggcgtcgatcctgtgaagatggagagcagaatccgcgaggtcgaccggaaacggaaggattactatcagtattacaccggtaatgagtggggaaaggcccagaactaccacctttctctggaaagcggtctggtgggcgtggacggctgcctgaaggcggtcctggcctatttggaatcggtgcagtagaagaaatacgatacgccccggagcgggacaggcccgatgcagtacgcagagctgcgcggccgtgaatatggatatcagattcctcagaagtcgggcagccgtcttttgaggaattttcgtatatgtatagaaaaatactcctgtcatgcaaaaacaccggcagaaacggatacggcgctggctggccgccctcctgaaacttttcttgtattatgtccacctttgtactataataatatacattatggattttgataaaatcttgatggaagtgcgaggtggaaagaaatcgatgcagtttgctgagagaatggaccgattcggagaaggaatattttctaaattactggagataaaaagacagaaggaagagcggggagagaccgtgatcgatttaggcgtgggggcgcctaacataccgccggccagacatattaccgatgccctgtgcgaggcggctgcggatccgaagaattacgtctatgccatcagcgaccagaaggagcttttggaggcggcagcccagtggtatgagaggcgctacggcgtgagcctgaatccggagacggagatctgttcgcttttgggatctcaggaaggactggcccatattgcgctgtctgttgccgatgagggagatgtcgttctggttcccgatccctgttatcctgtttttgcggatggtcctcttctggcgggtgccacccttttttatatgcctcagagaaaggaaaacggatacatcatcgatgtgagcgagattccggaagagacggcgaaaaaggcgaaacttatggtcatttcctacccgaacaatccgaccacggtcatggcgccggactgcttttacgaggaggtcatcgcgtttgcgaaaaagtatgacatcatcgtcctgcacgacaacgcgtacagcgagctggtatttgacgggaagacgtgcggaagcttccttcattttccaggtgcgaaagaggttggcgtggaatttaactccctgtccaagacctacgggctggcaggcgcgagaatcggcttctgtgtgggcaatgaagaggtggtgagccacttgaagatgctgaaatccaatatggattacggcatgtttctgcctgtccagaaggcggcggtcgcggcgattacgggagatcaggcctgtgtggagaccacgagaaaggcctatgagcgcagaagggacgccctgtgtgacgggatgacggagatcggatggaagatggacaagccggaggccaccatgttcgtgtgggcgaagataccggataatttttccgattccacctcctttgccatggaactggccgaaaaggcaggacttctggtcactccgggaagcgccttcggaccttccggcgagggatatgtgaggctggccctcgtccaggatgaggacgtgcttaaaaaagcggcgaggctggtcgatgaaagcggtatgctgcgatgacagcgaagaggagacagtatctctggagtgccgcggcggtgctttacgtgctgtttattttctccaattccatgaagacggccgacctctcctccgcggacagcggggcggtgcttaagctggtacagcaggttctgacagcgggaggcgtggacagcactatcattacggagcatgtgatccgcaagacggcgcattttacggaatacgccgcgctgggaatactgctctgcctctgttttcggacgtttgccctgtcactggacaggcgcgttctgtctcaggtgcttgtaagctttctggtgccgtttaccgatgagacgatacagctttttgtggccggccggtcaggacagatcagcgatgtctggctggactgtgcgggagcggccttcggaaccgtggtatttatggcagctggacggattttaagcaggacgggagtaaaaaaacgtgataaaaaattataagatagttcttcagtatgacggaagccgctatgacggctggcagaaacagggtaatacaggaaacacgcttcagggtaagctggaggggattttactgaagctcaccggacggccggtggaggtgcacggatcggggcggacagacgccggagtccatgctctggcccagacggctaatttccatgcagataccggtatgacggaagaccagatcagggcatactttaatcagtacctgccggaggatatcgccgtgctctctgtggagacggtgccggacaagttccacagcaggttgaatgctgtgaaaaagacgtatttatacaggattgagatgggaccgaagaaggatgtattcgagcggaagtactgttacgggctcggaaagcctctgtcggtgaaacggatggaggaagcggcggcctgtgttctgggggaacatgatttcaagagcttctgcggcaacaaaaagatgaaaaagtccacagtgaggacgatttcggatatcacatttgaaaaagaaggaacgaaactgttgatccgctatacgggaaacggttttttatatcatatggtcagaattctcacgggaacgctgatcgagattgggctcggagagcgcagtccacaggaaatgaaggaaatcctgctgaaactggaccgacaggcagccggctttacggcgccgccggaaggtctgtttctggagcgggttatgtatgaggacagggagtaacatgacagattttttagtgaagacttttgttaaggattacgagaatacgggagatatcggcgtgagaacggagtatggcctgatggccagcaccgtgggcatttgctgcaatgtgcttttatttgcggcaaagctgtttatcggactgctgatcaacagcatttccgtcatggctgacgcatttaacaacttatcggatgcggcctcctccatcatcggctttatcggcgtgaagatggcaggcaagccggcggatgaggatcatcccttcggacacggccgggtggagtatatcgcggcgtttatcgtggcatttatcgtcatccaggtgggtttttcgctgtttaagacgtctctcggcaagattcttcatccggaagagatgacgtttaagtatatttccatagttattcttctcatgtccatctgcgtgaagctgtggatgggaatgtttaacagaaagctgggaaagaggatccattcctctgtcatgatggcgaccgcggcggattccatgggcgatgtgggcacaacctcagcgaccatactgtccattctggtttacggaatctgggggctcaatatcgatggaatcgtgggccttatcgtgtcgcttatcgtcatgtgggcaggtgtcgggattgccaaggatactttggctcccctgatcggagagcctatcgatccgaagctttaccgggagatcacggaatttgttgaaagctttgacggaattgtgggaagtcacgatctgatcgtacataattacgggccttccagaagcatggcgtcgatccatgcggaggtaccgaatgatgtaagcattgaaaaatcccacgaaatcatcgattatgtggagcgggaggcacagcgccgcttcggtattttccttgtgatccatatggatcccattgagacgaaggactgcagggtaacggaatttaagaaaatggtggaagctatcgttaagagcatcgattccaaatgcagtttccacgattttcgtatggttgaaggtgaaaaacagattaatctgatcttcgatctggtcgttcccagggattacgacagggcggcgagagaacagatcaggacagagataacagagaaggtagcagagcgggatagcaggtgctgtctggtcatgacgacagaaagcggctttggtgtggaagaataaggaaacaaaaaaatttccataatatgcaataagaagacagcatcctgcattaacttagtagaaaggaaatcgactccatgttgtttatgggtatgatgagccttgatgggccggaagactacggccggttaagcgatgaggtgctccttaataaggttggaacgggagaccaggaagcgttcagacaattatatcagaatacagaccggtcaatttacgggtttatcctgtctattgtaaagaatccccaggatgccgaagagatcatgcaggagacctatataaaggtatggacttccgctgcgggttacaagtcccaggggaagccgctggcatggatgtttaccatcgccaggaatctatgctacatgaagtttcgcaatcagaagcatgagtccgatatcgcatttgaggatctggaaggcgaagagacaggggaagtatgcccggagattgaacaggcggcggataagctggttttggccgcggcgctcaagatcctgaaagaagaggagagggagattgtccttctgcacgcgactgccgggatgaagcaccgggagatcgcagcttcattaggcatgcctttggctaccgtcctgtctaaatataaccgtgcaatgaagaaattagaaaattatctgacataaagatcaaggaataaaaagagaggaggaagtgttcatgtttcacaaaaccgacagacaactgaacagagaacagataaaagcgcatttgaagtctgcggtcatggacctgactccgaatgtattggataaaatcgatttgagtgtgccccagatggcagcggaggagctgcatgaggaggcgggaagagccgtgagctccatcactgtgatgcgaaagcggatgcgcgtggttgcagctctggccgcggcgtgcctctgtatggtggcagtcgccggaggcacatatacgtaccgcaacggaaaagtggactccgtaatcggcatcgatgtcaatcccagcgtggagctgtccgtgaaccggaagaaccgggtgctggaggcagagccgctgaacgaagacgcgaaagctattatggaagacatgaatctaaagggtgttgatctcaatgtggcggtgaacgcggtgatcggttccatggtgacccatggctacctggatgatctggacaacgccattcttgtaacagtctccaacgacagcgtcagcaaggcatcagccctgcggtcatcggtcgtgaatgatattcagagttccctggaagaaaatcaggtgaaagccgtggtatacgaccagcaggtcatcgaagaggatcatgtgaaggcgctggcggacgattacggaatatcctatggaaaagcatattttttgaaagaactgatcgatcagaatccggctctgaccatggaggacatggagaagctggctcccctgaccatggaggagattgcaaaggagattacggagcgttcctatgcggtaggaggccacgcgggtgtgagcgaggatatgaccaccaccgcccagacgaccacgcagccggtcacgacagtgcctgtgacaacagaggcgacgacagaggaaacgacgacggcggaggaatccgagaccgagacggggaatcagacgacagcggctccggttccgcagacgacagcgccggctcccaccgatctgccggtgatgacgacagaggcgccgacgacggaagcgcaggtgccggtctcagatgcgaagatcaagatcgattacgtcgattatgagaatggtgtggtgacagtcaactttaagacaaaggtaaagtggaagaaccccaccgtatcggtaaaggatgagggcggaaccacgtattccgccatggtaggcgatacggacagctccacctgtgagatctacgtaagcggcctggaaggcggaacctcatatacgttcgttctcggcggaatatccccgaagaacgggaagcagacgacggtgaagggaaccttcgagactccggtaatcggggatggcgatgccaacgaggaaccggtagtgccgccggaaactgaagaaacaaaagaaacggaaacacagcctcagacgacggaatcgtctgaggcttctgccacatcaccggccgaaacagaatcggtaccggagacggagagcacccaggccactgagcctccgacggaagcgccggccgaaccacagacccaaccgccggctgctgcgacgtctgcggcgtgacgcgaaccctgtcatttgccgtacacgaaatatggtttaagctgtttgattgggacggtatctgagaatacagaggaacaggtgagagattacatacgcagtcagaaagaaaagcaggtgatgggttgctgcgggcatataaatatagaatttatcccgaccgggaacaggaaatccttctgggaaagacctttggctgtgttcgtttcatctataattattatctggaccagaagaagtcaaaatatgagacagagaaaaaaagcatgtcaaagaccgcatgcaataacgatctgaaccgaaggctgaagcaggaatacccctggcttaaggaagtggacaagtttgccctgaccaatgccatctggcatctggaagatgcattccagaagttttttaaggaaggggcgggatatccgaagttcaaatcaaagcacagccattacgatagctatacaacgaattttacgaatcataatataaaagctgatttcgggaaggggatgattcagcttcccaagctgagacaggtaaaggcaaagctgcaccgggaatttacgggacagattaagtcggcgacagtgaggcgtgttcccagcgggaagtattatgtatctgttctggtggaaacagaagaactggtatcagcaccgttttcagacaaaagcgtgggaatagatatgggaatccacgagtttctggtagacagcgacggaaaccatgtacagaatccgaaatacatgaaaaagtatgagaaaaagcttgcaaaggaacagagaaagctgtcccataagaaaaagggaagcaggaactgggagaaacagaggatcaaagcagccctggtgcacgaaaagataagaaatgcaagggaagatttttcggatcagctgtcggcacagatagtgagagaaaaccaaatcatgatcagtgaagatctgcagattcgaaacatggtaaagaaccgtcacctggcaggagcaatcagcgatgcgtcatggggaaatttcataaagaaattagagtataaaagcaggtggaggggaagaacctgccataaggtaagtccctggtatgcatcaagccagatatgctcggtatgtggagggaaaaatccagaggtaaagctgctgtccgtgagggactgggaatgtgagtgcggagctgtgcatcagagggatgagaatgcggcaaagaatatcctgcaaaaaggtttagaagagttaagaatcgtatagagaaaagaaaaatagggtaggaactatccgaatcaacgcctgtggagtcagtaggtaacgagaacgaagaaacaggaaactttaaaggtgactttagaagctcgtggctttagccatgagaggttcacggaataataaagaaaatagaaaaaatatggaaaaatggcttgacgaggagaatatcgtatagtataatacaaccgttgtgttgatgggctatcgccaaatggtaaggcaacggactctgactccgtcatttcaaggttcgaatccttgtagcccagttaaaaagctgatatttataagggaaaaccttgtatttaccagctttttttgttttttcaggtcaggtgagggaatggaaaacgccggaaacccacataaacactaagcagctgtcatacccaatattaatttgcaaatcactatttcaaaaaaataattcatattcaaagcggaggaaaggaattcttatggaattagctaaatttctacgcactgcgtatagagaattgaactggacaagtattcgtgcaattatgtatattgaagaaccggtaaaatgagatttttacattgagatgtgtaaaatcaaccattggagcacacgcatactgcaggaacggatacattgaaaagcgaaaagaaattgactgcggatctggtaacagggatggcccaattttcggatacacgttcgttaatgcttacagcaaatgggaagtcccaatgcccctcacgaatgaggggttagggtacttctcaacggttcctgaattcactcggctgaattcccgtataactcttaaatgcacggctgaagtagaagccgtctttatagccgaccagctctccgatcatctggatctccatgtccggattgttaaggagcagccgcttggcttcgttcattctcagcttcgtcaagtatttggacggagtttcccccgtatatttcttgaatattttccccaaatactccggcgtaaatccgaatttctcggccagctcctgaaaggagacatcgtgcggatagttttcctgaagatatttttccaaaagctcgcagatggacttttgatccagggcgctgttcctggtccggtaggtctccagttcctcggtctccgtccccatcgtgatcagcagcttctgaagcgactcggagagcgcctgcgcggtcaccggttttaacagataatccctgactgcgaacttgatggcggcctgagcgtaggaaaagtcgtcatagccgctgagaatgatgattttcactcccggatgattcttgtgcagataccgggacagctccaggccgtcgcactgcggcatgcggatgtccgtgatgacaaggtcgggacagtccttttccacctttacgatggcctccattccattggccgcctccccaatcagggtaagcggcaggtccagggctgtaatcttttttattaagtttttgcgtatcaggctttcgtcctccacgaccagatacttataatgggggatgctgctcatggtattcctcctcgttatgagcacttagagaccgtattttggtctcttacgtgcgatacttgccatctccactcagcgtgccccgctttatcgggtatagtgaggtttttcacgaacttagtggagcggctttgaatggtaaacaggcccgccaaggataaagatcgtcttaagcggcagtgtattttcgatttcaaatactgccttctctccgtaaagcagtttcagccggagatatacgttcttcagtcccatgcctccgatctgcatggatttcaactcctcattgaggtttaagttccggtacaggcggagcagctcctgcttcttttcatcttttagattgccgccgttgtcctggattcgcagcagccagcggtcgtgttcgatggaagcggagatggtgagctcccagggcggctgtttgtcgaaggcgtatttgaaggcgttttccaccagcggctggatgatcaatttgggaatgcagatgttttcggcctcttcctcaatggcaaaggtgtaatgaaattcctcggtataacgcatctgcatgatctctaagtaccgtttggtgtagaagatctcctcttttaacggaacgatcatctcgctggaggaggagatataccggaaatagtcgcacagggcctggcacatctgaatgatgtcctcattcatctcctcctcggccatgacgctgatattcgtcaggctgttgtagagaaaatgcggattaatcagcgactgtgtggcctgcagcttggctctcgtctcctcgctctgggataagagcacttcctgggaggtgctgcggagcttctcatacatactgcggatggattcgcacagcatggaaagctctgtgatattgctgtccgcggaagttagattcaccttattctcgtccagcacccggttgatggtaatcttgccggtggccgccgtcagcttccgaagcggtgccgtcagccgttctgagatatagaaacagatcagcagggtgagtaaaatggagaaaataccgatcagggcgaacattacccggaaggtgttaagaggctcgtagatggccgctttcggcttcgttaagatcacggtccagttatagtccggcgtggtccggtatgtaaagagaaggttctcgcctgcgtcggtttttaaaagcctgccggtattttccggaaggcctctgcgctcaatcagcccgtagtaatcgggcacaactttcgtatcattgtaagggtagaccagctcttttctggaattgtaaatgtagacacggctgtcagggttctggttttccagctgggtcgccagggagaagatggtatcgcagtcctgtatgacctcgacgatgccctccggctgtcccgcggtgtcgagaaacagacgcaccagggatatgaacttctgagaatccttattgccgccccttgcgggtaaatccttctgcacttccgggttgctgatatacatgtggccgttttgcgccatggtctcctcgtaccagggaagcgaatccaagtctacggaagagagcagcagccagtatccggccacggaaccgtccatggtgtagatccggacatcggaggccgactgataggcgccgatgatcgcggtgacaatatcgtggatggccagagccttctcacgggaggccgccagacggcgcgggtccgttccgttcctccgataggaggctgagaactctttgaaattggactttaccgcgttggagtatacgatattcatggaaatggtcgatatgttgtttaactgggtttccacagaattttctacagaggcgcacatgttttctaaatcttttctcgcttcttccagagcatttttcctgtaatgcgtgtaggtgaaaaagaaaaaaatccccagcagaagcaggatgaacaggccatatatgacaaaaagatacatcttttgggaataatgctttgtcgtctttttgataagaacgccacctcccttcgtgagtgctattatacaatgtagttcaaaaaaatgcaaatggtagttcggaattgtctattttgtaaaaatgactcttatgttatgataaatttacgctaaaggaaacgtattttatcgataaaatataggcacaaaagacaagtgtggaaaaagagtgagaatcagttgagaaaaggagaacagatatgaaaaagatgataaagagagcattaagcctttctatggcggcggtcatggcggcggcagtggtgacgggctgtggatcagacagcaatacaggtgcggcaaaggatgggaagaagagcgtaaccctgacctttggcagccaccagagcggccttccgacatcgggaatcgtccaggatttagcaaaggaatttgaagctgagaccggaatcaaaatcgacttccagatttcccccgacgcccagtggagagacttaattaaggtgaagctggattccggggaggcgccggatatcatctgtgtggatacgcccatcggtctggcctccagcattcacatggaccagtacagtgcggagctgaccggacaggagtgggtgagccgcatggaagacagcgcccgttcggctgtctccgtggatgacaaggtatacggcatcaccttcccgggagcgaagatgtatttctatctgtataataaagacatattcagccagcttgggctggaggcgcctgctacatacgaagaattcaggacggtctgccagaccattcaggattccggaacgacaccggtctatgaagccaccacaaacggctggcatcaggtacttcccctgtttgagaccggcggattatggctggccgatgatcctgaggtctacaacaagttaaatgcgaatgaagtggatttagactccattccccacttactgaacatcatcacagaattagatgagtgtgcaaaagccggatacttcggagatgactacttaagcaacgcatgggagaatgcaaaagaggccatagccacggagcggtgtgccatgaccattgccgagctgggattccgcggtgagatcgaagccgattatccggacttcaaggcgacagagaagctgggggcgttcgttatgccgtgggatgacaacaaagcagtcggcgtcaatcccgccagcaatgcctactttatcaacaaggacagcaaatacgtggaagaggcaaaacagttcttcgagtttctggcgaaaccggaaaaccttcagaagcgtctcgacggacagccggaattaagtgcgctctgctggccggagattaagagcaaatactccgatgaggaccagaagttcttagattccctcacaaaagccaacgtggtgcagacttctgtgaactacatcgacagccagtggatggatgttgggaaagatttggaggcaatgtataccggagccatgacgccccaggatgtgctggatacgatcatgagacggcgtaccgaacaggcggagctgcagaaggacccgggctgggtaaaataacggcggcggaaaggaggtacggtcatgaacagaaacaaattatatccctggtactttgccagcggcgcggcgatcctctttttcctgctgtgcttccttccaggtctgctgggtatcgcatattcgtttacagactggaacaatttcagtgatgagatcaattttgtcggccttaccaactataaaaagatctttcagggcaattccgagtacttaaaatatatcggcaacaccgtgctgttcacggttgttaccacggtcatgaagacggttgtcggccttgcgctggcccttcttctgacccagaagtttatcaaatgcaagaatttccagcgcatgatcatcttttccccacaggtcatgtcgtatctggtggtcggcctcgtgttccggagcatgctccatccgaccaccggcttcttaaacaattttctgaggggaatcgggcttgacgggctggctaaaaactggctgaccgatttaagtctggtgttcccgacggtcatgaccgtggatacctggaagggcatgggctacatcatggttgtcgtcatcgccgggctgatgtccatctcgccggagtactacgaggcggccagcatcgacggcgccaatttcttccagaagctgtgggatatcacgctgcccttattaaagccggttcttgtcaatgtaacggttttaaatgttacatacggcctgcgcgtattcgatatgatctattccctgacaaacggaggcccgggaaacgctacaggcgtaatcaatacagctgtttacaaggaattctccaagggagatttagccatgggcaccacgctgtccagtgtcctgtttttctttgtgctggcgctgctttactttatcatcaaatccatggaaaataaggaggtggaagcatgatgggaagaaccggcagaactatcggccgtgtggccggaaacctgatctcaatcgtaatcagcctgatcgtcattatcccgctggtggtgctgttcttaaattcctttaagacctcggccgaggccaaccggatgacgctgtcactcccgacgaaatgggtatttgaaaactatgccaccgtcatcgaacagggaaaactggtgtcctccttcttcaacggactcctctatgcggccggcagcgtaatcatcgtagtcggactggttgcggcagcagccttcgtcatatccagaaaccagaagggcgtcaaccgttttctatattactttatcatctccggcatcgccatgccgatcaacaatgtggctttgatgaaggtcatgcaggcgtttcatctggtcaacaccagaatcggcatcattctcttatatgccgcgatcaacataccgctgagcctgtttctggcctacggctttgtggcgacgattccgcgtgagattgacgaggcggcggtcatcgacggatgcaagccgtggcagctcttcttaaaggtgattgcgccgctgttgaaaccgattgtttccacgctgtttgtgctggatttcatggcagtatggaacgattttaccatgccgctgtattacttaaacaattccagaaaatggcccatgacgcttgccgtctataacttcttcggggccttccagaattcctggaacctggtggcggcggatatcatgctgacgctggcgcccgtgctgctggtctttattctggggcagaaatacatagtgggcggtgtgtcggccggatctgtcaaaggttaaaacagagccgttaaagacggctgaaaaaaataagcctgcaaggaggaggaacgaatgacaatgcagaagatctgggatctgatccgggaaatgaccctggaagagaagatcgggatgattcatggacaggggattttccatacgaaaggtgtggagcgcctcggaatcccgccgctctggatgtcggacggccccatgggggtcagaaaggaactgcaggacgacaactgggcgcctaaggggacgacggacgattacgtgtcctacctgcccagcaatacggccatcgcctgcacctggaaccgggagcgggcggcagacatgggatgcgtgctggggcaggaggccaggggacgtggaaaggacgtgatcctggctccgggaatcaatctgattcgttccccactctgcggcagaaattttgagtacatgagtgaggatccccatctgatctcggaaatggcagttccgcttatccggggcattgaggagcaggatacggcggcctgtgtgaagcattttgccttaaacaatcaggagacacgcaggctcgatgtggaggctgccgtggacgagcgggcgctcagagagctctatctccccggcttcgaggccgcggtgaaagagggaaagacgaagacgctgatgggagcctacaaccggttccgcggagaacactgctgccataaccattacctgctgcaggacattctccgcggggaatggggctttgacggcgtggtcatatccgattggggaggcgtccacgacacgatgcaggccgcggaaaacggactggacatcgagatgtcggtgaccagtgattttgatcagtactgcatggcggacccgctggcggaaaagatccgatccggagaggtccccgaggcgctgctggacgagaaggttaagaatatcctggttctcatggaccggctccatatgctggacggcgtcagaaagagaggctcctataacacgagggatcatcaggaggcaatcctcaaatgtgccgaagaggcgattgtgctgttaaagaatgaaggcgggattcttccgctgaagccagtgaaacgcctggcggtaatcggggaaaatgcagggaagatgcattccagcggcggcggcagcgcggcaatcaaggcgctttacgagcttacaccgcttatgggacttaagatggagctgggcggagccgtcagcgtagagtatgctccaggctaccagagcgacggtgaaaagtcggcggaacaggaaaactggcaggcggagagcctggaggaacgggcctataaggcgtcctataagggagacggaagcgatgcggcggagaaacgccgcagagaactcataagggaagccgcagccctggcagaatcctgtgaaaacgccgttttgtttatcgggctgaatcacgagttcgatctggagggatgcgaccggacggatatgaagcttccttacggacaggaggaactgatctccgctgtcctggatgccaatgagaatacggtcatcgcagtcacggccggttctccggtggacatggaggtctttgccgaccgggcgaaggccattgtatatagcagctacaacggaatggaaggcggcctggccatggcagaggtccttctcggtagggtgaatccttccggcaggcttccatttaccatcccgaagcggcaggaggactgcccggcccattccatcggagagtttccgggcggtgattccgttgcctatcgggaaagcgtctacgttggctaccggtattacgagacggagcgaaaagcagtccgctactgctttggtcacggattgtcctatacggagttttcctatggggatttaaagctggagcggcgggaagacggcatcaatggtactgtgacagtgagaaactgcggctctgtggctggagcggaggtcgtggagatttacgtcggtgcagccggaaagactgtcaaacggccggccagggagcttaagggatttgtgaaagtccgccttcagccgggcgaggagcgcgccgtggatttccggcttccatggaaagcattttcttactacaatgaggagaaaatggcgttcgaagtgccggaggatgagtattcggtctgcgtggggcggtccgttggtgacgtgcggcttgttcagaccgttgaaattaaagaaaacgatgcattaggaggaaaatgttgatgaaattcacagaaggttactggtgtaccaaaaaggaaatcactccgctttacgcggcagaattcgcagacagccggatacatggggatgaactcataatctatgcgccgggaaagcatatcgcgggaagaggagactgcctgaatctggggatgctcaccatctgtctttccagtccaatggaagatgtgattaaggtttccgtgaggcattttgagggaaccgcttaccgcggccccttcgccgggattaaggagaccgccccccatgtgacaatcgaggaaacagaggaggagatccgctatcagagcggccgcacatctgcggttatcgataagaggccgaacggctggggaatccgtttcctcgacggagaccgggaactgaccaacaccggattccgcaacatggcccatatgaccaaccgggatacgggaaaaacctatatggtggagcagctggccatcgatgtggacgagtgcatctatggacttggtgagcggtacaccccgtttgtgaagaacggccagatgatggaaatgtggaatgaggatggcggaacggccagtgaaatcacctacaagaatattccgttttatattaccaacaaggggtatggcgtgcttttggatcatgagggggatgccgcctatgagattgccagcgaaaaggtggagcgcctgcagttttccgtggaaggggaacggctcgattactacgtgattaacggttccaccccgaagggaaccatatccaaatatacggagctgaccggcaaaccggcgctgcctccggcctggtcctttggcctttggcttaccacctcctttacgaccaattacgatgaggagacgacctccggctttatccagggtatggcggaccgggatataccgctgcacgtgttccattttgactgctattggatggaagcgtatgaatggtgtaattttacgtgggatcccaggacatttccggatccggccggtatgctgaaacggtatcacgaccggggattaaagatctgtgtgtggatcaacccgtatatcggacagaaatctccgctgttccatgagggcatggagcacggctacttaatcagaaagacgaacggggatgtatggcagaccgatatgtggcaggccggtatgggactggtagatttcaccaatccggacgcggccgcctggtatcagggcaagttaaagacgctgctggatatgggcgtagactgctttaagacggatttcggtgagagagttccggtgaaggatatcgcttattttgacggttccgatccggttaagatgcacaattactatacgtttctctataatcagaccgtattccagcttctggaacaggagagaggaacaggggaagccgtgctgttcgcccgttctgcgaccgtgggaggacagcagttcccggctcactggggcggtgactgttcggcgacctatccgtccatggcggaaaccatccggagcggcctctctctggcctgtgcgggcttcggcttctggagccatgatatcagcggttttgaaaatacggcgccggccgatatctacaagagatggtgccagtttggccttttaagctcccacagccgtctccatggctcttcctcctaccgcgtgccgtggctgttcgacgatgaagcctgcgatgtgcttcggaagtttgtaaagctgaaatgtacactgatgccgtatctctaccgtcaggcggtaaaagcccatgaagagggaatcccgatgatgcgcccgatgttcgtggaatttccggaggaccgggcctgcgagccgctggataagcagtatatgctgggcgattccctgctggtggccccggtattcaaggaatccggcgaggtggaatactacttaccggagggaacctgggtgaacttgcttaccggaaagaccgtcgcgggaggcagatggcagaaggagacacacgattacttctccctgccgctcatggtgcgccccggcagcattgtggcggtcggacaggagagcagcagaccggattacgcgtttgcggagggagtcagattccttctgtatctcccggaggatggaatgaccgcggagaccggcgtaacggacttagaaggccacgtggtgatgaccgcagcggccagccgggcagatggaacgattacgcttcgggtggaaagaaccgccgcggctgcttccgggggcggttcggcggacgtttcagcagacgtttcagcagacgttccagcagacgtttcagcaggctttacgtttgaggttctgggagacgaaagggtggaagtggtagttgcataatgcgtttactcttttcagactatcaacgtttcttcagccggaactgctcgaccaggccgtttaaaaggttcgcctggtcggacagctcttcgctggccgcggcacactcctcggcggttgcggagttgctctggattacggcggtaatctgatcgattcccatggtgatctgtgaagtgacctccgcctgctttaaggaggctttggagatgaggtccacggtctcggctgcctccacggcaccgtttacggcttccatcatggcggcggctgtctcggaggcaatcgccgcgccgtttttcaccgccttcatggaactctcaatgagagcggaggtatttttggaagcgtctgccgtatccccggcaaggtttctgacctcatttgcaatgacagtgaagccctttccggcaacaccggctctggccgcctccacggaggcgttaagtgccagaatattcgtctggagcgcaatggattcaatggtttcaatgatgttgccgatctctcgggagctgctgctgatttcgtccatggcggcgatcatgcgctgcatctgccgattgctggcgtacatctgatcgccgaccctgcgggctttctcactggcctgctccgcgttggaggcattgccccggatctgaccggagatgtctccgacaaatgcagccagcccttcgatggaacccgcctgctcggaggtgccctgagagagggactgggcaccggtggctacctgttccgcaccgctcgctacctgatcggaggcacggttgatctgtccgataattccatttagggacccggaaatatgttccaaagcctctttgatcttcctgaattcaccggcgtagtcgtaggtcagttcaaacgccaggtcaccgtctgcaatctggttgagcacggcagagatttccttaatataattcacataatccttaagccgtgttactgtcttgttaaaatttacggccagtgagcccaattcatctttcgagtcatacgtgatcacttcatttaagttgccgtccgcaattcgggcggcggcgttgtcgagttcgttgacaggggtaaggatggctttcactgtggcaagggataacagaaatcccgcggcgatcaggagtacaatgatcgagatcagaagcatccacgctctggaatagagaagcgtgctttcgtggcttgcagtctgggcgtttgtcttgctgtattcgaccagctcctcgaaaatctcggtggcttcgtcaaacagcttctgggaatcggcccgtgcgatcaccatggcctgctccatctcgccgctgcggctcagttcgactacggtgttgtgcagctgcaggtaatcggcccaggccagtctggcggaggcgagcatctgcttttcctcatcgctgctgccaagctgatcgtattcggcaaatttggcgtcgatttcaaggagaaggtctgccatctgttcttcccgcaatgccatgatatccggctcccaggcgatgatgtgtccatattccctgatgcggaaattggaggtgagtgtgtccagttcttctgccgtgacaacggaaggcagccagtcatcgttgatagccgtgttgcgctcattcatccgatacatgaacacgagggagactacgccgagtgcggtcagacccaacaacaaaaaggtcgtttgcataagcagttttgttttgatacgcagatttttcatttgtaacccctttaccccttaaaatgtaattcaatttatatgaaaaatatcaaaagttccgataatataagaatagcattaaaaatagaaaatacaactaaaatattgagtaaatttaaaacaaaaaaaataaaaagaagtaaaaaaaagtgcttgactatcggacagacatcgtgtatactacatcttgctgtgttaatgggctatcgccaaatggtaaggcaacggactctgactccgtcatttcaaggttcgaatccttgtagcccagtcttgataaaacccgcaggaaagttcctgcgggttttgcagtattttgtgagaatagcgtcttataaattgcagaaacttgaaaagaagcaggaatccataaggaactgcttctttttctgcagtagaatcgctccttcttctggacaagacaggcaaaatgctttataatgttacttaattttgatgagaggtgcagcatgtacacatttggcagcaggatacggtacagtgagacggatgaatacggtaaactgactcttacaggtatcatgaattacttacaggactgttcgacgtttcagtcggaagacatcgggctgggaatttcctatctgacggaacaccatcaggcgtggtggctttcttcctggcagatcgtgatcgaccggtaccctgcgctgggagaagaagtggtcatcggaacatggccctatgatttcaagggcttttacggataccgtaattttactatctgtgatccggccgggaattacctggtgagagccaattccgtatggtttctgtttgacacggagctggggcggcctgtgaaggtgaaggaagagaatatccggggatacggccgaggcgacgagaagcgcctggagatggagtacgcaccgcgaaagatcaccgtgcccgctgaatatgaggaagcggagtgcgtgacgatcgcaaaacaccacatcgatacgaatcatcatgtgaacaatgcccagtatgtggagatagccagggaggtgctgccgtctgaaatcgaggtgggagaactccgggtggaatataagaaagcagccgtctgcggcgatgtggtttatccgcatgtcagccggacggatgaaggatacacggtttctctctgtgacgagcagggagccgcttatgcagtgatatggctgcggggaaaaacgagagaggatgtaagatgatagaactgggaaaagtgcagaccctgacggtacagagggtcaaggagttcggtgtatatgtgggagagggcgtggcttcagaagcttccgtgctgcttccgaagaaacaggttccggaaggagcgaagccgggcgatgaaatcagcgtatttatttataaagactcggaggaccgtctgattgcgaccacgggaatcccgaagctttcagtgggagagaccgcgatgcttccggtaaaggaagtggctaagatcggagcgtttctcgatatgggactggagaaggatttgcttctgccgttccgggaacagacacataaggtacgccagggagaatcggttctggtagcgctgtacgtggataagagccagaggctggcggccaccatgcgggtttacgcttacatgagcagtgagtcgccttataagaaggacgatcaggtgactggaacgatctacgagatcaatgagactctgggtgcgtttgtggcagtcgacaataagtactatggactgattccgaagaaggagctctttgacgattaccatgagggagacacggtttcggcccgggtcaccaaggtgcgggaagacggcaagctggatttaagcccgagacagaaggcgtacttacagatggacgacgattcggcgcgggtgctggaagtgatcggagaccagttcagcggagtgcttccgtttacggataaagcggcgccggaagtaatcaagcgcgagtttcagatgagcaagaacgcgtttaaacgcgcggtaggccatcttttaaaagatggaaaagtaaagattaccgagaaaaccatagagatattgaaatagagtggaaaggaataacaggaggattgttttggactcgatagactattataataagtatgcggcaaaggtgttcgaagagacagtggatcaggatatgtcggagataagaacggagtttttaaatctgctggaggaaggggatacgatccttgacctcggatgcggttccggaagggacagcctgattttctacgaactgggatacgatgtgacagccatggacgcatcagaggagatgtgcaaactggccgagattcacacaggactggaagtactcaacatgacgtttgaggagatggatttcgacagcgtgtttgacggaatctgggcctgcgcttccctgcttcacgttccggaaaaggaactgtctgccattcttaaaaagatagcaagggccttgaaagacagcggaattctttatatgtcctttaagctgggagattttgagggcttccggggagagcggtatttctgtgattacacagaggatgccatggaggaagtactgaaagacaacgaccggtttgacgtggtaaagatctgggaaaccgaggatgtccgttctggtcattctgacacacggtggctgaatgtcctggtcagaaaacagtaaatcttacgaaaatatgaacaagacagcgcgaagaaattcggcgctgttttgtcgtttccgcccaaatccggtctggagatgccgcaggttagagatattagacagaaatgcccagccggatctttctatattttggcgtttcagtcattttttttattgaatatacaaattagccaaaaggcagatttggattttggttaaatgccatatggtaaagataagaccattcatgtatgataaggtcaggaaatgaaaaggacggcagcacaaggggctgcggggtccgaggagaaaaacaaacacatatttttatttaaaattaggaggattaagcgatggctagtttatcattgaagaacatcacaaagaaatatccgaacggattcgaagctgtaaaggatttcaatctggagattgcagacagagagtttgtcatcttcgtaggaccttccggctgtggtaagtccacaacccttcgtatgatcgctggtctggaagatatttcttccggtgaactttacattgatggcaaattaatgaacgacgttgagccgaaggacagagatatcgcaatggtattccagaactacgctctgtatccacatatgaccgtttacgataacatggcattcggtctgaaactgagaaagacaccaaaggacgagatcgacaagctggttcatgaagcagcaagaatccttgaccttgagcatttattagacagaaagccgaaggcattatctggtggacagagacagcgagttgctatgggacgtgctatcgtacgtaatcctaaagtcttcttaatggacgaaccgttatccaacctggatgcaaagctgagaggccagatgcgtattgagatctccaaattacatcagagactgcaggcaaccattatctacgttacacatgaccagacagaggctatgacacttggtaccagaatcgtagttatgaaggacggcgttgttcagcaggttgattctcctcagaacttatacgacaagccaggcaacaagttcgttgctggatttatcggagctcctcagatgaacttaatcgaagcaaccgttgcaaagaacggaagcgacgttactcttacattcggcggtcacaccatcgcacttccggaaggaaaagcaaagaagttagagggcgctggatatgttggcaagactgttgttttaggtatccgtccggaagatttacatgacgaggaagctttccttgcatcttctccgaacagcattatcgatgcaaccatcagagtttacgagcttttaggtgctgaagtttacttatacttcgatgttgacgatgcaaactttaccgcaagagtgaatcctcgtacaacagcaagacctggcgataccgtgaagcttgctcttgacttaacaaagatccatgtattcgataaggacacagaactggtagtcttaaactaaattttatgaaaatttaagcaggcgagtgctatactcgcttgcttttttttagtttttgctttaatatagaataagggaaaatttacgataaggagagtgtgccatgatttcgaatcaaatacttcaaacgacaattgaaggattaaaaggaattacgagaattgatttatgcatttgtgatacggaaggaaaggtattggcaacaacatttcctgacgcagaagactatgagagttctatcctggcatttgtggattctccggctgacagccaggtaattcagggataccagtttttcaaggtttttgatgagcaccagttagaatatattcttcttgccaagggaggcagtgacgacgtatatatggttggcaaacttgccgccttccagattcagagtcttctggttgcttataaggagcgttttgataaggataacttcattaagaatctgcttctggacaacctgcttctggtggatatctacaaccgcgccaagaagcttcatattgagacaaacatcaagcgtgtcgtatttatcattgagacacagcacgagaaggatgtcaacgcattagagacagtccgcaacttatttgctgccaagacgaaggatttcgttactgcggtagatgagaagaacatcatcctggtcaaggaagttcgggacggtgagacgtatgaggaactggagaagacggcaaacaccattctggacatgctgaacacagaagccatgacccaggttcatgtagccttcggtacgatcgtcggagaaatcaaggaagtatccagatcctacaaggaagccaagatggcgatggatgtaggcaagatcttctacagcaacaagaatgtagtcgcatacagcaaactgggaattggacgactgatctatcagcttccgcttccgttatgccgtatgttcatcaaagaaatcttcgacggcaaatcccctgacgagttcgacgaagagacactcaccacgatcaacaagtttttcgagaacagcttaaacgtatccgagacatcgagacagttatacattcacagaaatacgcttgtatacaggctggataagttacagaagagcacagggcttgatttgagagtatttgaggatgcaattacgttcaagatagccttaatggttgtcaagtatatgaagtacatggagaaccaggactattagtgaggcatgagcagtgcgaaaagagacagtaagaaatcagcgttgtgctggcacaaaagcggatttcctgctggctcttttcatagggcgaagcccggaaaccgagacagcgtgccccgcttcatcaggtatgaagcgaagcggaatcgaggtttgcactgcggggtagtgggtcgcgacaaaggaaattaaaagacttcagaggataaagatgatcgaactgtggaatgtaaataaaacatacgaaaccggaaacaaggctctgcgtaacatcaacatcacagttgaggacggggagttcgttttcatcatcggccggagcggctctggaaaatctacgcttttaaagcttcttttaaaagaggtggaaccgacgtccggcaagattattgttaacgatatgaacctagggaagatgcccaggcgctacattccaaaataccgcaggaggctgggcatgatattccaggacttccggctgttaaaggaccgcaatgtctatgagaatgtggcatttgcgcagcgtgtcatcggcgcttccgcaaggagcatcagagaatcggttccaaccatgctgaccatggtgggactctcatcgaaatacaaattttatccgcagcagctgtcaggaggcgaacagcagcgagttgcgattgcaagggcactgattaaccgcccggagatacttttagccgacgagcctacgggcaatttagatggccacaactctatggagatcatgaagctgttagatgagatcaacaaaagagggaccacggtaatcgtagttacccacagccatgaaatcgtagaccgcatgaagaggcgggttatcaccatggatcgtggaaccatcgtaagcgacgagaaaaagggcggatatacacatgaggattagtacattttggtattgcctgaaacagggcgtaaataatatatgcagaaatattctgttttcgcttgcttcgatcgcgacgatttctgcgtgtatttttttgttttgcctgttcttttccatcgtagtcaatgtgcagtatgtggttaagaatacggaaagcacggtgggaatcaccgtattttttaatgaaggtacaacggatgagacaattgcccagttcggcgagactttgaaagcgagaccggaagtaaaagagatcaagttcaagtcggccgaggaagcatgggaagagataaaaggtgattatttcggagaggataagatggatttggcggaaggcttccgtgacgacaatccgcttgccaactctgcttcttacgatattttcctgaatgatctggaaaatcaggaggaatttgttacctggctgaagagtcaggacattatcagaagggtgaactattccagcaccgcggcggaaggaattaccagcatcaataaggtaattggcgttctgtccgtgatgattatcggtgttctcctggcggttgccattttcctgatcagcaatacgatctcggttgcggctgcattccggaagcatgagaacgaaattatgaaattaatcggagccacgaactatatgattcgtgcgccgtttgtagtagaaggggtgcttttgggaatcttcggagctttgattcccctcgtcgccatctattatctttaccggaacgcggtgggatatgtggtggagaagttcagcatcctgtccggcctgttccagtttctgccggttgagcagatattcccgtatatggcgggaaccgcgctggcgctgggcgtcggaatcggattttttgtaagtttctttacaattcgtaaacatttaaaggtataaggggaactgcatatgaaatacagaaaacggatagaggcggccgtcatgaccgcagtccttaccgtatcctgtatatttccttcctatggtacaaagactgatgtagatgcggccagagaaagcaagtcaaatctggaaaacgaaaagaaagaaatagagaagacgattgaaaaactggaagtgttgaaatctgacaccgcatcttatgtaaatcaattggatgcggaactgaattccttaaacaagcaggtaaccgcccttaattcccgcgttgcggcgaaggaagcggagatcgaggaggcggaggcagagctggccgcctcgaaggaagatgagagacgtcagtatgaaagcatgaagcttagaatccaatatatgtatgaaaagggtgagaccagttatttagacttgttgtttaagtcggccgatctcacccagctttttaatcgtgcggaatatatcagtcagattgcggcatatgatagaaaaatgctggatcagtatgaagcggccagtgaagaggtggctgccagagaggcagacctaaaggcagaacacgaggagctggtaacgcttaagactaatacggaagaaaagcagaaggacgctgagcgtctgatgaatgaaaagacagcggaactgaaatcctataacagtaagatcgcagccagcgagggaagtctctcggatttggaaaaagacatcgctgcgcaggaagataaaattaaggctattgaggctgaactcaaacgaaaagaagaggaagcgaagaaggccgcattagaggcagggaagaagtataataccgttagtattgggaatattaacttcatatggccatgtccggccagcagcaggatcacctcctcgtttggagaccgggaatctccgacggaaggcgcgtcgtccagccatcagggcatcgatatcggcgcatccacgggcagcagcattctggcggcggcttcaggtaccgtaaccatatctacatacagttattctgccggcaactatatcatgatcaatcatggaggaggtgtctccaccgtttacatgcactgttcggaacttctcgtttctgcagggcaggaggtgacacaggggcaggtaattgctaaggtgggctctacaggttattctaccggcccccaccttcattttggcatccgggtgaatggaagttacgttaatcccataaactatgtaagtccataacccgaaagacaaggagaataacattggaaaacaaaaataaattttggaaaggcgccctggtcggcgcacttctgacagcatttgcaggactgatcatcgtgggcatgtccctcggaatatttctgattgggagaaccgcgatcgacgggccacagcaggcggccgaatcgaatcaggcggaaaaccaggatggttcgctggatttaaaccggatcacgaagaagatcactacgcttcaacagattatagataaatattatcttttcgatgaagatgccacgaaggtggaagactggatctacaagggcatgatgtatggcttaaacgatccgtatacgacgtattacaccgctgaggagtaccagaagttaagcgaggatacggaaggcgagtatcatggaatcggtgtcatgatcagccagaacagaagcacaggaattattactgtgatcaaggtatttaaggatactccggcggcggaagcaggcatgaggccgggcgatgttctctataaggtaggcgatatggaagttaccggaatggatatggatattctggtaaaggattatatcaagggaaaagacggctccgaagtggctcttactgtcttccggcaggatgagggcgaatacgtcgatttgaagatggaacgccgcaatgtcacagtacagacggtggaataccagatgctggaagaccatgtagggtatattgcggtgagccagttcgatgtagtgacagccgatcagtttaaggccgcggtcgatgatctggagaaacagggcatgaagaagctcctggttgatttaaggaacaacccgggcggcgttttggatacggtggtggatatgctggattatatccttccggatgatttaattatcgagggtgataaggatctggtgcgtaccaacacggaagcgacgctgcttgtgtatatggccgataagaatggcaagggagggcaggaatacgcctccgacggccattctctcgatattccgctggctgttctggtcaatggagagtccgccagcgcttccgaggtatttacgggagccatgaaggattacggcagggcgacagttgtgggaacaaagacatttggcaagggaattgtgcagaatctgattcctctggacaatggaactgccatcaagatgactacggctcactactatacaccgtcaggcttcgatttacacggtaagggaattgaaccggacgtggaagtggagctgaaagaagagttaaagaatcagattacggtggatgtgaaggaagataaccagattcaggcggctctgaaggcgctggataaataactgtttcgacatataagaaaacaaagaaaaaaggattagaatcgaaggcatgaaagccccggattctgatccttttttcattatcttcttatattaagtaacggaacagctggaagagacgggaggtaacggcaaaaatccatttctttttcggagggaccggaatcaccggaacgtccgggtccgggacataggtgccgtctgcctgtaccaccagggaatcggcttccagatcgtcgatgcaggccttaagctgtcggttgaacacttctccgtcgatgaccagcatggtctccgtatccacataggtgcttctcatatccaggttataggaacccacgatagagagacggtcgtccaccaggatcgattttccgtgggaagagtgatctccgaaatattcacggagtgagactcctgtatccagtatttttccgcggtttcttgtgtaatcggaggaggccataaaattgtcgcctacggaagtcgcattcaaaagcatggtgacctccggtacggaatcggtgatttccttcattccttcatacatgtctttgctgaagacagcgtatggagtgtggatataagcctgtttctctgcgtgtgccatcaggtactggacctggtaccagacccagggctccttggcaagaatgtgggtgggattggagatcagggtggccttgttgattgccacggtctccggtccgtagtcgtgaccggccagaaccagctccggcatggcttctttcagggtttggtaatactcggccagctccgcccttgcagcgggcagtttcttcttcatggacgcagagggggcgttaaacacggttttgcagtacctggactgccacatcgcctcgaaatattcgtctgcttccgacagaacgctggaggaccatgcctcctcctggccatgcttcgtgttatagatcatcacgtcacggtcatagcttagattgcgcaggttatattctccaaggaagtaatcaaaggtgttgcggccgcccagcagcaggagcttatcgtcaataagcagatatttgtcatgcatgcgcccgttgatggtccacggcttcagcgggttgggaatattataaaactttatctcaatgttcggattggtccctgccgcgtagaagatcgggtttccctgcatatgaagggttccgtacaatccgtccaccagaatctggacctttacgccacggtccgcggcctccagcagggaagagaagatatcccggcagctggagccgtcccggatatcgaaggtggagagcacaatgcgtttctccgcctgatggatcattaaaacgcggctttccagggcatccatgctggtctctacgacgcgggccctgtcagcactttctgtctctgaataaaaagaggctggttcaaagttatttttaaattcttctcccgttttctttgtatgtacgaagggaagcagggcccctgccgccaggtaaagcagatagagcagcagagcccatctcaggatgacgaaaatacgccgtttcatatcatatcaatccttttttaaacatgccctggtactacactccgtagtatcgttagatgcagttatttgtttttgcagttttgaagggctgcgacgaaggcgtgacaggcgtcttctctcgtggcccaggaagtgacgagacgaatcgcactggatccgttggtgccgcgttcctgaatggaaaagagaaaatccgcgcttaaggcttcgatgaccgcatccggaaggatggggaacagctggtttgtcatggattccgagaaaaaggtgtaaccgcactgttcaatcccttttcttaagatggatgccatatcgttggaatgtgccgccatatcgtagaataaatggttctggaacagctcttcgaactggattcccagaagccatcctttcgccatcatggcgccgcgctgtttgatcatgaagcggtaatccggctttaattcgtctctgcagatgatgagcgcctcaccgaacagtgcgccggccttggtgccgcctatgtaaaatacatccaccagctccgcaatatcgcgtagggtcagatcattgaccgggctggtcagtgccgctcccatgcgggctccatccaggaaaagatagagatcattctggcggcagatatggtgcagggcctctaaatcggcttttgaatactgtgtcccgatctccgtggagttggagatatagaccatcttaggctgaaccatgtgctcatcggtatgcgtatccagcgcctttaaaacgtctgccggggttaatttgccatccttagacggcatggccagaactttatggccggtagcctcgatggctcctgtttcgtgaacattgatatggcccttgtctgtggcgataacagcctgccacgggcgaagcgcggcggcgatggtaattaagttcgtctgggttccgccggtgataaaatggacatccgcatcgtttcgtccaatctcttcttttattaagcggcgcgcatttttgcagtgaatatcgagtccgtatccgccgttctgtgctaagttgcagttcatcatcgcttccagaatctttggatgagcgccttcactgtaatcgttgttaaaactgtacataaacagtcctccctgtatctgatagtctgagactaatcatataccaaatgagggggaattgcaaggtgggagaggaaaagcggagggggggctgagaaggtggacgcgatcgtagcgtttgtggaaggaagtatggggcttgaggaactccttaactgccgaaccggcatcagggcagcactacatccatcaaattattcacaaattgagtacatattatgttgaatttttctgctctccatattattattttagtaaggtacatgataaatgagacaagacaaaatgatagtggcagtcatagtctggagacgttagaaggatatatggcggcccaacaggcgctattgtacgttttatacacgaaagataaggagtttattagagacatgagaaaagaatacattaatatgaatgtattcgatgcactgcagaagagatttgcgtttttatttcaggaatttaaaaatatttatatctcattcagcggcggcaaggatagtggtgttcttttgaatttgctgctggattaccggaataagtatgcttcagatcgcgtgattggcgtatttcatcaggattttgaggcgcagtataccgtgactacggactatattacccgcacttttaagcgactggaaaacgaatctggcatagacctttattgggtctgccttcctatggcgaccaggacagcactgagtagttatgagatgtattggtatccctgggatgaaaccaaacaggatatatgggtgcgtccgataccggagtatccctatgtcattaatttggcgaagccttttacccactatcgttaccggatgcatcaggaagatttggcaaagcagtttggccggttttacaaggaggagcatgggaatggcagtacggtctgcctgcttggtctgcgggcggatgaatctttgcagcggtacagcggttttgtcaataagaaatacggatatcaaaacgagtgctggatttccaggcagttcaaagacgtatggtgtgcttcacctttatacgactggtcaaattctgacgtatggtgcgctaattatcgcttcaattatgattacaataatttatatgatctgtattataaggctggattaaaaatagaccaaatgcgggtagcatcgccttttaacgactactccaaagatgctttgaatctataccgggtcatcgacccggaaatatgggcgaaactggtggggcgggtgcgcggagcaaattttggtgcgatttatggaaagacaaaagcgatggggtaccgcagtattacgttaccggaagatcatacatggaaatcttatactcattttctgctggatacattgcctgcccgactgcggaataattatgtgaaaaagtttaatacttccatccatttctggcatgagaccggaggtggattaccagaggaaacaatccttgagcttttggaaaagggataccacattcggagaaatggtatctctaactatacaattaacaaaaattcccgtattatttttcttggaccgattcccgatcataccgatgatatcaaaagcacgaaagatataccaagctggaaacgaatgtgttactgtattttgaaaaatgaccatacctgtcgatttatgggatttgggcttacgaggcaggaacaaaagcgtgtggatattattaaatacaagtacggagggatgataaatggtaaataaggaattcagaagcccagtatacagcatcattgcggtaccatttgaaaagattgtacccaatacctataacccgaacaacgtggctccgccggaaatgcagctgctgtacaacagcatcaggttggacggttatactatgccgatcgtctgttattatgtaaaaagcaatgataaatatgtgattgtagatggttttcatcgttggcgggtaatgcgggattacccggatatttatgagcgtgagaaggggatgatgccggtttcgataatcgataaaccgctgtccgaccgtatggccagcaccatccgtcataaccgcgcccgtggaacacatgatgtggacttaatgagtaatatcattaaggagctgcacgagttaggacgttccgatgcatggatttccaaacacctggggatggaccgggatgagattttgaggctcaaacagattactggcctggctgccctgttccgcgatgtgaagtttggacaggcatggcggcccgtggaggattcggttccagatgaagagccctctggcagtgggaaaacagatacagattaccagtgaatagaatgatagcattggcaaaaaactggatatgagttttaaccattcaaactccacagacggttttgaattaattttcaggccgtctttttctttttctcctacatgagatttaaatggtaattatgtgtatcttaggaaataattaattatttatccagtatatataaacacattggtgccacaaattcggtataatatagatgatttaaactgaaaggagtgtcatgctttgcttgaaaaaatacttgttgttgatgatgagaaggaaattgcggatctgattgaagtatatcttcaaaatgaaaatatggatgtatataagttttattcaggggaggaagcgcttgtctgtattgggagtacggactttgacctggctatattggatatcatgcttccggatatcagtggactttcgatatgtcagtccatacgaagtaaggagtacacatatccggtaatcatgcttacggcaaaggatggagagacggataaaattaccgggcttacgcttggtgcagatgattatattacaaaaccgtttctgcctcttgagcttgtagcaagggtaaaggcccagcttcgccgttacaagaaatacaatgtgggctcagcggttccggcagcgaatgaaatctttaaatatgccggattgacgatgaacattaagacgtatgaatgtcggcttaatggagagacgctgtcattgactcctacagaattttccatactaaggattcttttagagcgaagatgcagtgtcgtcagtgccgaagaattatttcatgaaatctggcaggaagaatactataccaagagtaacaatacgattactgtacacatccgccatcttcgtgagaagatgaaggataccggggaaaatcccagatatataaaaacggtatggggggttggatataaaattggtgaaatttaaaaaagcagagtacaactattcaaagctcggccgtattacgtttatccggggattatggattacagtgggagcagttgctgcagtctttgtactgcggatgctgacacgcggacacctggcagatgcgattgttgagtggattgcacgcattctttcaatcagtgagaatgaagctgatttaatatatttccagatggtgactgctaatatgcagtttattcttgcgttggtcataatcatatttgtttttttgttgttccatatgctgttggatacatataaaagatattttgatgaggtagtaacagggattgacaagcttatggaagaaagggcagccatttccctgtctccggagttggagagtgtggagcataaactgtctgatgtaaagcggacgcttgcagaacgggcggataaggccaagagggcagagcagcagaagaatgatcttgtggtatatctggctcatgatatcaagaccccactgacttctgtaatcggatatctcagccttttggatgaaaccccggatatgcccgatgaggagaaagcaaaatatatccacactgcatgggaaaaggcgaaccggctcaggactctggttaatgagttctttgagattacccgcagtcactcagaatctcttccgcttcaaaagacaaaggttgatctttactatatgattgcacagatttcagatgaattgtatccgcagttaaatgcatgtggaaaaattatagagaatcatgtagatgaggatatatctgtatatggagattctgataagctggccagagtatttaataatatcctgaaaaatgctatttcttatagtgaggaaaacagcgttatcaaagtatctgccagagagctttcagaatggactgtgattcaatttgaaaatgacggggaaattccggaggataagctcaatgtgatttttgataaattctgccgtttaagcaatgcgagattaagcgaaactggaggctccggcctcggacttgctattgcaaaaaatattattttactgcatggcggacagataaaggctgaaagcagtaatggacgcactgctttcatcgttgaaatcccatcagagtttaatagccgcgtccgatccgccgtatcgccttaggaatttcttaatcattcatttaccattccatagaaaatcaattatctcaaattaaaaaattgcctgctcatcaatggtatgcttaaactgcctgatagagcaggcaatatttatatgaaaggaggtaattttagaaaatggaggtggctatgagaaagaagataagacggattattacaattctgggaacaacagcaatgatttttaccataacagcctgtgggaaccgcatggataccgtgcagcctgctgcttcctatgttgcagacttttttgatattccagacaccgtgacaggaatcgaaagacttctgctcaaagatgatatggcctatatgtgctatctggaggcggatggtacgtcctatttggcagcaatggacattgatgacggcaagtttttgaaacagaatctggatctggatgcttctgtctcgcttctggattttggctttgccccggataacagtatctgggcggtttgcctggagaaggcaggcgtttatagtttgaggaaatttgacaacagtggttcacaggtccaatcggttgatctggcaggtgtgatggacaccccggtcatatcggcagttggaagagatttattccttagcattgatagggaggggaatatctgtgtggctgcaaaaggcggaaatacgttggtctatctattcgacaataacggccgtttcttattttctcttgattatgacggtaatcttatgacaaccacaacgactgccggaggacagattggtatttgtgcgacttcctcagaccgtatgaactatgatctgctgacagtggacatggagaggcaggattggagtaaagataaaatctgtctgggagcaacaacaggactgtatggaggcgtaaacaaagatttctatcggtttgattcttccgttttgtatgggtatgctgctggcgcacaggagggcatccctgtccttaactggtcggatatgggacttggcacatcagaagttcatcttggagaatgcacggatgggcgttttgtggtcctggcagcctcatccaatcagactgaggtactgtcatatgaaatggcggtgctaaccgagggtgtggatgagagagaacttttgagtatggtgagcctgactgcgactcctggccttgtccaggccgtatccgattttaacaaaacaaacgacaggtataaggttgagctgacagagtattttccgtatgcacaaaatgtttccaacgaggaatgggataatgccattttgaatcttaatacgcggatcatctctggtgatatgccggatatcctggatatgagtaatttgtcagtacagatttatcaaagcaaggggctcctggaagacctttatccatatatggaaaaggatccggaaatccggacagaggattattttgaaaatgtctttgaagcgatcagtctggatggaaagttaccttatcttacagacggagtagccatatccactatgctggctggcgcggatgttgtggatggaaacaatggctggactattcaggatctggaaaaggtctttgatacttacggagccaattccataaacaatctgtctggtgcttccttcctgaaaatcatgcttcagacagatggcagctttattgactggaacctgggcaagtgctcttttgatacgcctgaatttgtaaaaatgctggaatttgccggtaaaatacaggaaagcagccagaacggctttggaggaacggagatgagtgatacctatgcagcagcatatgaagcagtgctgagcgtttaccatatcaccaagtacagaaattacttcaacgggaacctgaagtttcctggacttcccggagacggcggtgaataccatgcaatcaaacctgaagtgaaggttggaatctcctcgtccagcacccggaaggaaggggcatgggaattcgtcagaacactattgacagaggaccaccagatgtcctgtatgatgcttccgattcatcggagggcttttgataaggtcacgcaggcagcggtggaaggaaaatctatctggacatggatttacgaagatggtaaggcaacaaaagaagatgtggagctgacaaagcagcttttaaacagcgcagcctatgtggagaatgacaatcagacactggaagcacttatattggaagaggccggggaatatttttcaggggcaaggagcgcccgggaaacggctgaaagaattcagagccgggccagtctttatatcaacgagcaaatgtaaaatttttatatgcaatggaaaggattcaatattatgaaaagacagcttaagaaaagacagtttatgaaaagaggaatgatggggatatatgcagctatctgcgcggggatgcttttggctaccggatgtgcaggtacagagccaaatgtaaaaaaggaaacccctgagaagcaggaggaggtccataatgaatcacctctgcaaattcagggcggtgccgggaacgaggacttagatacaatggatacgtttgcagatgcgaatgacatgatgaagtctgctgatttgagcggcacagccggcgaatgctcggataccgggttcgtgattaatacatcaccctttgcggatggcacctcatcttccggagatggaggcagtataacggttacttattcagaagacgcagtatttcaaaagggaaccgtgaaatcggatggcagcagctattctttggatggcagtgaaaaagacgggataggagataacgattttgtactgtgttttggaaagcagcaggcagacggctcttacctggcagacagaatcattaagattgtatttaattaacctgacaggagatgatacagctatgcgtttacatattggggaaaaattcagacaacaaaaggccatgcttatttccggaaagaaatacaggccccttatagaagaacgtgtacagcgcatggctgtatatcttatgattggattttttgcatttatgtttgtatgcacaatcatttcccgtgcatcccattcttttacaactgcccatgttgtagtgtcttccatgacaagcaaaacgttaatgaacagggctgaaatggaagggattatccatgcggcagcagagaatgggattagccttccggatggccttaaggtcgtgtccgtcaatgcaggggagggcaaaccggtagacagaggtgaaatactgatagaatttgatataccttccgtagaagaacagattaagaagctggaagaagaaatccatatccttaacctgagaatcgatctttcagcaaacaatggcggcaatgatgtgattgaggcacagcgtaagcttgcagatgcccaaaaggcgtatgagcgcattgctgcgaagtatgacaggacagatctacgattaaaagaagattatgtaaaactcgaagaaacactggaagatgcggaaaaaaatcttattaagaaggctgaagagcttgtgaaagatgcgagggaaaatctggagaatgtaagggaggatgcggaggacgccatccgtgccgcggaacaggcgctggatgaggaatcagaaaatcttgatgatgctgaggatagttatcagcaggcattagaaacgtatgagcaggcgaaagaggaacttaataaggcaaaccagagagtcagcgaaataaaggaagcaattgcagggaagcagccggacgatgccacggattatacggaggagctgaaggctgcggaagaagaactttccattgcgcaaaaggcatttaaccaggcaaaaaaggagctttcaaaagcagactatacctcatcgtcctatgacagggcagacgataaccgggactccatcaagagtcgctggaaacgtaaaattgaaaaagccaaagatgctctttataaagcagaaacagtgctggaagcagtcagggaaggaaaagatttttcaagtgagtccgcagtcagtgaggctcaggcagctattgatgctgcaagagaagcgttaaaccatgcccggcgtgagtctgaggatatccagtattctgaggaggaagaactttatgcggcgggaagggcaatagagaccgcgcaggcagcattggaagatgcccggagacaggctgatgtattgcagaaggaagaagagattgacaggcttaccaatgaatctgagcggacagataaggaaaaatcgcgtgctgcactgcaggaaattttggataatgggggctgccttttggctccggcccctggaaccgtggtgaggacgctggaacgtggggataaaacaaagaagggggaagatgcagtcatactctcctctgctgacagaggatttgtttttgaaggaaaactggataaagattcagcgcaccgcttttcagccggggacacgggagagctttattacaaattggatggaagctcacaaaaagcagatgtggagattcattccatcagcacgccggacgagtcggaccaggttttagtaactgcggttctgccggagggaagttattcttccggtatgccggcacagctttttctgagcagaaagagcgagacgtatcaaaattgtctgcctcttaccgcactcagaagtgattccagcggggatcacgttttcgtactccgcaaacaaagctccgtactgggaacagaatgggtcattgcaagggtagatataacagttaaggaaagagacagtcagatgatgtatgttgatggagcgcttacgtattcggatcaggtagtcataagctcgaataagatcatatcggaaggagacagggtccgcattgaaaattgagaggtttgcccattaccgggcgttgacaatatcagcattactggcagcggttctttggtgtttcgcctgttctttctatagtacggccatcaatcactgtacaagtgtgagcattaaatgggaaaagggcggtgtcagcccctcagagcttatcaggcagcagacgtatgcaaggcaggatggagcaggaaaccagccggaggccaccttatgggagatatacccggaacaggagataatggcttcagataaaaagaaaataaaggcagatatagttgccgcctttggagactgcggggatattgtctcctccatgctgactgccggtgcttatccggccagatcggataagtccggatgcgcagtcagtaccggtctggcattttccctgtggggaagtaccaatgtgattgggatgccggtaaaggtggaaggaaagcagttctatgtccgcggcatatttgaggaggaagaaccaaggttgttcttacaggcacaggcagactcggaaaaactcttatccaatatgcagctgacatttacaggtccgggagcaggggagagggccagtcagtatctctcctcggcaggttttccggcgggacggattcttgacctgacattatttgcatgggtacttggcatgatattccggcttcctgcggtcattctggcgattggtatccttggacgcgtgatcgggcatggtaaaaggctttgccgttatccccttctgctggcagtttatcttttaatcgctttcggtatatgcgccgtattatggttttgtatagaactgcctgagtttccttccgagtttatccccacaatgtggtctgattttgaattctggggaaatctgtttaaggagcaggggaaaaatatggtctcctggatggcggccgggcctggcttccgggatatggagctttggatctcgtcatttatggcagtgctgctttctgtgtgcgcctctgcctttacggcagccgcagcaatgctggtatccatacgctcttacaaaagaatgattttctattgtgcggcatatacactgacactttgcctgatttcatttaagatagcctctgctcacaatatgaccttttgcaaaacaatgtatcttctgccatgtttgtggatatgtgtggattttctcttttactgtctgaaagaaacgcttgccgccgatgttcgtgaagggaggattttggatgaggagaaaacgtgaacacagtgttccgatccgggaacaaatggtaccatggctgtttttgctgccgagcctgctgttcgtaagtattatggtgctgattcctatgctggacgctctgcgccgttctttttttctggctgccagtgaccggtttgtgggatttcaaaattatctggcagtactgaaaaaccatgcgtttaagctggcggcagccaatacagcaagatttattttagtctgcataccgcttctgttactcttttccctggctgtttccctgatgctgacctccttcagggaaaaacgcagcattttcaagacctcgtttcttgtgcccatggcgattcccgttgcttcgattgttcttttgtggcgggtgatttttcataaaaatggactgctcaatgcatttcttgcactatggggtatggttccggttgactggattggaagtaaggcagcctttggtgtattggtgtttgcttatctgtggaagaattttggatatgatatggtgctgtggctgtcaggactcagtgccataaatccggcattatatgaggcggcgcagatagacggcgccggaaacctccagcggtttgtaaggattacactccccaatctaatgcccacattatttaccattaccgtgctgtcgctgctcaattcctttaaggtgttcagagaggcttatctgattgcgggaggttatccggatgacagtatttacatgcttcagcatctattcaataactggtacggcaatctggatgtggataagatgtgtgccggagctgtgatgatggcaattctggtatttattttgatattactgatgcaaaaaattatgaacagaggagatgggatatgaaaaaatggcttcttggcgtgccccttgttttgattgcggtctttatatggctgcctctgtggatgctgatatccggtacttttatgggaggggcagagctgtctgaaaatcttgcgccagtcctggaaggcaggggaggaacggctgtatggcctgtaattgcgcgttatccgacagtggcggcatatgtggaactattattggatacgccccagttttttacagtattctggaattcctgcagacaggtttttccaatcatactcggtcatgtccttttgggcgctcctgcggcatgggcatttgcgaagtttcactttcgcggaaaaaagatactctatacgttgtatattgtcctgatgctgatgccatttcaggtgactatggtttccagctatcttgtcctgaataagatgggcctgattgataccgtatgggcggtcattctacccggtgcggcatcaacgcttccggtattcatcatgacacgtttttttatggacataccggaggcggtcatggaggcggctgccgtggatggggcttcctcatttcagacatttttacgatttggacttccgcttggcgcgccgggaatcctgtcggctgtggtattagggtttttagaatactggaacgcaatagaggcgcctcaggcatttttaaaaaaccaggcgctctggccgctttcactgtatatgtcaaatatcacagcggataacgccggggtatcattgatcgcgtcactgattacgctgatgcctcctctattgatattcctgttcgggcagaaatatctggagcagggcattatatcttccggaatgaaagattaacacaggggattaatttatggaaaacaggaattttgcaggcgatctgcagataagcaaagtaaataaatggtatcctggagatgttcatgctgttaaggatatggatatggcaataaagagaggggaatttattgtatttgtaggcccttccggctgcggaaagacaacgctgctgcgcatgattgcaggacttgaaagtataagcagcggcgaggtcgttatggatggcaggattgtgaacaaggttccgccaaagaaccgcgatattgccatggtattccaaaattacgccctttatccaaatatgaaggtaaaagataatatcgcctttccccttaaaatgcagcacatcggcaaaccggaaatcgagagaagggcagcagaattggcgcaaaagctggagctggagactctgcttgaaaggaagccgggggccttgtccggcggtcagcgccagcgtgttgcccttgcgcgggccatgataagaaaacccggactttttctcatggatgaaccgttagctaatctggatgcgaagctccgcacagaaatgcgccgggagattataacgctccaacgggaactgggggtaaccaccatatatgttacccatgatcagacggaggcaatgacgatggggacgcgcatcgccgtaataaatggcggtgttttacagcagtttggaacaccgcaggaaatatatagaaatccggcgaatctgtttgtagcagggttcataggatcacccaatatgaatctatgggacacaaggcttgttacataccagggacagcattatctgactttgggaaatacccatattcccattgatgtgagcaatttgcccgcagatgttttacgggagccgctgaaggccggtattcgcccggaacacattgtgccggctgcaccggacgagcctcatgcagtaaggatgaaaatcaatattctggaaaataccgggcgtgaagtagcagttttcctcacaggggctgacatgccgaatcttacagtggtgacggatgcagatttttccggtcaggttgggcaggaggtatatattcggcttaagccggaaaagatacatctatttaatatagagacaggaagtgcatatggaaatgcatatggatagaatattaataacaagtaaagaagttaccgctgcatcaatcatactcgtacctatactatttttatatcataaaatatttttccacaacataaaaaagacggccgcctatatacttttttccttatatctggctgcaatatgctttttggtgggatttcccaatatagcagggctgagaatcgttttatctcataactttattcctctgcgtgggatgttgaccgatattacgaatagctacctgaatattttactttttgttccattgggcatatttgccccctgtttatggcgcgattatagaagtatgatgaaaacggtgcgtttgggcgtgcttacctccctggtaattgagatatcacagatatttaccattagggcaaccgatatcaatgacgtgataacgaatgcggcaggaacaatgataggatatttaacaggcagattgattattaaacggattcctcaattagaccgacttggctgtaaggaacatgagttatatcttttatatgcaacggttggtgtagtaatgttttttttccagccgtttattcagtctgtattaagtaatttctctttattttgaaaaattgagcatagctggggccagcgggggattcggtcttacgatttggacgggcatatcatagaaatcggtgaggatatgaaaatggaggctacttatttttctttcaggatataattaacactgttacctgttaatggatcgctgcccatagggatttttttgaaagatatttgtctcaatgcaggtaccaagatgcctaccatgccgcattaatctattgtctgggaatcagcgaggatacaagacgtaaataagtgtgaggtgatacatagcttcagccagtttccaaggaaaattgcagtgaaaagcattctaaccggcagaagatattcggtattcccagaatggcattgctataattctgagcagatagcaatacaggccgcagaaaaatacaaagaagggtatgttgatatgatttactaatgatatttctgtttcaataaaatatgaaaaatatgatagtaacacgttatttaccttcctcatattatatagtacaaactattaaggaggtaaaaaatgttctgctgcaaatgttgttgtagatgttgctgtcatagatgttgctgtcatagatgttgctgtcatagatgttgctgcccgtggtgttgtaattgggggtgggaaaataactggggaaacaattgggacccctgtgtgaatgaaagacgtcaagcatatagagcaggatttaatgacggatatagagtaggattcgaagatgggagatggagtcagcgtccatgcccacgggataaatgaggataatataatcatggcgggcgctggaaaaacgacccgccttttataaaataattgtagaaaggggagagcttttttataccactttctacgccatagtggtttagtgttattactttgctctgaccagttctattgcctctttacctgtcatgtgctcaatctctaaaacaaacatacataatggcttccattcccgttcaatcgccttttcccggttttcgtttgaatcgtgcggatgaaattttgcagctaatgcatggattgcataccgcatatcactttcttctgagataatatgaacttttccaaaggcaattacacttctaaagtaggttgtgtattcctctggcacgacagaatcttgatcgattacacaaaaagaagccttgggctgtttcctgattgcgtccagcttatgaccgactttggccccatggaaatagatcttattctcatagtatatatagcttaacggaacagcatatggataatcgtcatcgccttgtactgctagcaccccagaggttcctttagtgagaatatcaatggtttcttctgcagatagaagttgcttatttcttctcatttttctaaacatatcctagattctccttgataaaatcttatttaagcattgaaacaaaaggaagcaccaaacctttctatcttcttagacctaatgatagaaagtctggtgcttacattctttaccaggtggcaaagaatagcgtatgcattattatacaacgagaaaacatgattttcaatttactattttgtggattattttaatgattttattacctggtttgtatcaaggcttttacttttaataaaaaaggaagtaattccacagtgaggtttacgacactgctcccaatttttctttatatcgctcgtagcaccatgaccttggtgaactccccaccgtctaaagccagagggattgcggtcgccgtatttcagaagatcataagccatcgtattgatcgggctttttagaaaaaatcgggataatctgaaagtcaggataacagcaaacaactagtatttttctggaactcgaatattagctacattatagaacttatatttttctaccatgtgttttttcatactaatcaaaatatagcggtaacaatcagccataccatctgcaaaggaacttgcatttcccttatataattgccgaagtgcggtaatggcttttttgttcagattggagagagtatgtctcttggacggatagtaagcaaaatggtgtccccattcaagaaggtgattggtttcggatagtataacgtataaaggttctaatgtggtatgtttcaatatggcatctagaatatctgctaaatgaatagaacctggtgaagtaaatctgtctgttaactcgttcaattcttctctggtaaaccgtactgctgcagctaacgccgccggacgaataattaatatcattagctgcaaggcgtgaaaataacgtaatgctttctctatgtatccagaattaaatgccagctgatgaagtttcgtatcatccggttctatgactatagtgcctttaccatttaatttctttatgaatccccgttgttcgagttctgacaatgcctttctgactgtcgataaagagacatcgtactggttagccagttgcttttcatatggaagaaatactccaacagaatatactccaaggccgattttcagattcatgtcatcaacaatttttgagtaataataatcctggccgcgcatgggattccacgaaaacttcaaaccagtttgttcaggacatttgggcgttgtctctgatagataatttaacgtatgttcaatggaatccgtaagttcctgatatatatcagataactggttgtaatttgtgagtggatcatcgccctttaatgtatctacaataacactggttactgatatagatccctgcaaaaagtgcttagagaaataggggcagtcttctgcaaagaatgcaagcttattatagaggccgaatgttgaataaagttcgctgaataaggaattcccacctatccttaatatattatatcctaatttagaaggagaagaccatcctcctgaggcatatcccaaacgcaatgctttcatagcttgtttatagtggggcattatctccacatcacacccctgcagggcaaaaaccataagtgaaggcagtattagagcaaaagtctgatatacctgtaaaatgcattctctttgttttaaaatctcaaaaacagtatttgatgaattataagtatctttttttgaaacaacaattggtgcaagacgaggctgaatatcaaccagcccttctgcccgcaatgcgtcaaagacacggttaatcgtatatctgcttacatgaaattgttcgcaatacatccttgaagatggaagagcatttccaggaggtatttggccttccaaaatatactgcttaatttcgttatatataaatgtaaattttgtttcttgtggtttcacaacccacctcctctctgtctgtattatatcacgacaaaaccaatgctgtcagtataaaagtgtcaacctatatgcacaccttaccaatatgaatattgccagaatatgaagataacatttataataaaatcgtaaaattatttgaaaagagtttaagaaccatggaaaaacaaaaaattttaattgcagacgattcagaaatgaatcgcgcgcttttgatagatatcctggaagaacaatatgatgtggcagaggctgaaaatggtgtagaagcaatttctattctttcaaggcatagaacagattattcccttctgcttcttgacattatgatgcctgtgatggatggatttgaagtattagcttacataaataaatatcactggaatgacaccttcgctgttattatgatttcggctgatgattccccagcgaatataaagcgagcttatgacttgggagcttttgactatatcagccgtccgtttgattcgaccattgtccagcgccgaatttctaatacaatgtttttatatgcaagacagcagcggcttgagaaaattattgcagaacaatttcatgagcaggaaaataataataggctaatgatctcaatcctgtctcatattgtggaattccgtaatggagagagcggcttgcatgtattgcatgtgaatactattacaaaatatttactaaagcagttgattcagtgtacagatcaatatcctttgtccaaagcagagatttctttaatcagtactgcttctgcgctgcatgatattgggaaaatatcaatttcagatgaaatattgaataaacctggacgtcttacggcagaggagtttgaagtgatgaaaactcactcgatggttggcgccaatatactgttagaactgcccattgaacagcaggaagctccgcttgtcaaagtggcttctgagatttgccgatggcaccacgaaaggtatgatggcagtggttatccggatggattaaagggagatgaaatccccatagctgcccaggtggttgcgctggccgatgtatacgatgccttgaccagtgagcggtgctataagaaagcctattcacataaagaagccttgaaaatgattttagaaggacaatgtggtgtatttaatccgactcttttactgtgtctgcaggaaattgctgatacacttgaaagtgagcttatggaaacctctcctgaacaggagacaaaaaatattcaggatataagaaataaaatagactacgacagattgttttcctatgaaaaatacgccttcctgtcctgcaaacagcggcacctgcaattattatatattgattcgttaaccagcgtctacaatcgccgttattatgacgagcattttcaaggttcagatgatattcaagcgatggccgtaatagatgtagataattttaagcatatcaatgataatcatggccacgatataggggatatcgtgttgcaaagcattgcacaaactgttttatcctgtgtacgaaaaacagatgccgtaatccgttatggcggcgatgaatttgtaattatcttttttaatatacctcaggatatattcgggaaaaaactggagaggattaggcattccgttgacagtttgataattgatgaccgtcctgaattacatatgtctgtaagcataggcggagcttatggtatcggaactataaagaaactcttcaaagctgcagacaatatgatgtatcaatcaaaaaaggcgaaaaaccaagtgaccatatattattttgacaggaatgaggacaacacagacaacatttaaaaagaccaggaggaaatgtgattgtgaatctaaaagattgttatataaaatttggcggcgattttgatgaagtactgggcaggctgcggcgtgaacagaccgttcagaaatttgtatataaattcctggacgataaaagctttagcttgtttgaagcatctatgggtaataaagactatgccgaggctcttagagccgttcatacgttaaaaggaatttgtcagaatctttcttttgccagattatttgaaagcagtagtttagtaacaaaggcattaaaagaagatgattggaataaggctcttgatatgatgccgcaattatcaaaggactaccatgaaattattaatgctattgaagaacttaagatttccaaggaggaatagcgtcaatgggaaacagtaaaaagaagaatcctacaacgcgttttctaatatgcagtttcattggacttttaatcttcagtattattatgttcagcctgctggggatatacatgagtcgaaagagtaaaagggccgtttacgaaattggagaaatttatatgtccggaatgaatgagcagatgtccagacactttgaatctgtcattaaattacgttttaatcaggccagcggcattgtttctgttgtcccgacagatatgaacgataaagacagactgtatgaggaactgacttacagggcacaggtcagggaatttgactatttagcactgtgttctgccgatggggagtttcaaactctttatgggcaacccatacagccccttaaccccaaaccttttgtagaagcattattacaaggagagcaaagagtcgctgtaggcattgatacggctggaaatgaagtcgtattgtttggcgttgatgctgcttatcctatgcacaatggcgatcggagcaccggtctgatagcagccgttcctctggaatatatcactgatttccttttcttaaaggaggaagggcagctgatgtattatcatattatccggccggacggtagttttgtaatacaaaatcccaacacggagctgcggtatttctttgaacagctgcaaaagcagtctgattctgcagtgaatgaatcatcagctgaaaatccggttgaaaaatttagtgctgctctgaaaaaacatgaggaatatacggcaatattggaagtaaatggtgaagaacggcaaatatatggtatttcattaccttattctgagtggtacttagtatcggtgatgccgtatactatattggacaatgccatacataatctgggcagccagcgtatattcatgacattgttgtcttgtgcttctgttttaatcattctaacagtgatattcctccggtatttctccataacccggtcacagatgaatgaattggaaaaggcccggcaggcagctcttgaagcgaacaaagccaaaagtgaatttttagcaaatatgagccatgatatccgtacccctatgaacgcgattgtaggcatgactgcgattgccgcagcccacatagatgaccggaaacaagttgagaactgcctaagaaagattacattatcgagcaaacatctattagggcttattaatgatgttttggacatgtctaaaattgaaagtggtaaattaactttgacaacagagcaaatttcattaaaagaagttgttgaaggaattgttaacattatgcagccacaggtaaagacaaaaaagcaaacttttgacatacatgtggaaaatatcttgacagaaaatgtgtggtgtgatggtgtacgcttaaatcaggttttgcttaatctcttatcaaatgcaacgaagtatacaccggagggaggagcaatccatttatctctctttgaagaaaattctccaaaaggagaaaggtatgtccggatttatatcaaggtcaaggataatggaattggtatgtcgccggattttctaaaaagaatatatgaatcctatagccgtgcggatggagccaggatacataaaaccgagggagccggtttgggaatggcgattactaagtacattgtggacgcaatggaaggaaccattgatatacaaagtgagcctgataaaggtaccgaatttcttcttacgtttgattttgaaaaagcggatgcaatgaatatggatatggttcttccctcttggaatatgctggtggttgatgatgatgaattattatgcagaacagccatggacgcactaaaatccatcggaataaaagcggaatggacattaagcggagaaaaggcaatagaactggtaaatgaacaccacaaaaggagagaggattatcaaattattctgttagattggaaactacctggcatgaatgggattcaggtcgcaaaagaaatccggcataatctaggagatgaagtaccgattctgctgatttccgcatatgactggagtgagtttgaagcggaagcccgtgaagcaggtattagtggttttatttccaagccactttttaaatctactttgtattatgctctgcgtcagtatatgggcactgaaacagaaaacggccagacatcgaaccccaatagtgatttatccggacgccgtatcctgattgccgaggataatgagcttaactgggaggttgcaaatgaattgttgtctgacttgggcgtagaactggattgggcagaagatggacagatatgtctggacaaattccaaaaatcaccagagggttattacgatgctgttcttatggacatacggatgccccatatgaccggttatgaagccacaaaaatgattcggggactaaatcatccggatgctctatccataccaattatagctatgagtgcagatgctttttctgatgatatacagcattgcctggagtgcggtatgaatggtcatatagcaaagcctatcgacatcatggaggtaacccggttgctgaaaaggtttctgatttaaggtgccatagaggatttttagagaacaatttggtagaatttgactataatcagcagaaatatttataactgctgattatatcttttatagaagaaaggagaactaaatgaaagagagagtaagaaggctggtttttatggcgggcattctatgtaccatgagccttgcagtgtgtgcatgtggaagtacaaaacatgaaccgatagatgcaaatgtaactgcctcaacagagcagccagaggttgcaagagaaacacctatggaagaaactgtttccactcaggaatcatttgcaggaaacacctttgagaaatgggaagagaataattcaaatctggaaggaagcattaaggaactccaggaaggacagttcacggttgtagaggctattacagaaaagtcagacaatggtggagatatcatggtatccccaggcattggcgatgattccgactttaacaaagtcatggttacatatgatgagaatactatagttgtaatacagactatcaaaaatggtggggccagctatgaaatatcagaagcaactatcgattttctatcagaaggtcatatggtaagagtatggggaaccctgtctgacaatagactgaaagcaacccggatttgtattgtgaaggttgtataaatatcttaaaaaattctgactagttggaagataacgagaatataaaaggaaatatgtttgcaaaaaaacaggagagcaatagtgaagttatttcagaagatgaaagtaaaaaatgtgtacccgtgttatttcttaatattgcttgttacagttggcattcttttgatagtagttctgtatgggaaacagaacagcagcaaagacggaaatatccttgccggggcaagtccggatacaagtgctttccagctgtattattttgatgggagagccgttacagtgagaaccctgtatgaccccggcatggaaaaagaactgattaaaaagattaatgcactacctatggagattgcagacgaaggtgcacttgcaggtatggaggttccattttacggaatctggattagtgatgaggacggatatgatattaccgtggcactatccaaaggtgtttggcttaaaaatgatggtacaatttattatggggacacagacctttcacttttatgggaacaaatggagggggaggatgaggataattccctaacggtgctgaattttcccaatgcagggcttttggctgcatatcatccgttctttatgctgaaagcggaggatcctgacggggaagccgcggagggggtggttatatctgtggaggatattcagccaagtaggattaccgtatccattgcaaataatagtggagaagaattttcttacggcaagtatttcaccctccagaagcagatagacggccaatggtatacaatgccggctcaggcagataatatcggttttgaggatatcgcctgcgtcttgccagatgggaaaactgcgagtgagacctatgaccttaatatttatggaacgctggagccggggatatacaggctggtggtagaaaattatagtgttgaatttttagtcggatacggaaatctgttcgcaaaagctcatgtatttttaagatatattaaagtacgttagggaacgaagtgaaattgacagaactgtatggaagtggggacaaaaaaataccaactactttatgtttacgagggaactgaacaagttgaaacaggttaaggcctaatctggatccgttggctaataccatcgtagggaggcgatttcttacgccgcagtgtgcatggaagagcttcttattgattttgaggctcttatttttagtccttagcaaattgagagtagcagaaatcggaattgagttgattacagttttgacaggatttttattatcgggatgtgtagtaagcaaagactttctgtcgagttgtgattcgaaaataacagagtatgttatggagcttgtgcaggaatcgtggaaggggcgctatgacctggaaaactgcatcgttttcgttacagaagaaaacgatggacaggtggtctggagaatgacattccaggcggactggaagttattttaattcagaagtaatggaggaaaaaagatgaaattagagagatgtgagaaagaatccttttcggtaatagggaaagaaggttcatcattagatggagtagggtttatccagaagttatggaacgatgcaaattctcattttgcggaaattcagcattttgcaaaaaaagatgctaacggaaatataagtggaatatggggagcaatgactgatttctcccgttcttttaatccttgggaagactttgataaaggactctatcttgcgggggttgaatgtaatgatgaggcagaagctcccgatggttggacaaagtggattattcccggttatgagtacatttatgtggaatgtgaaagtgaggatacttgttcaaagacaataaaatatttgaaagataatggcatctcgttggtgggagcggttcacgattttattagtccgctgactgggaaaaattatatgttttttccaattaggaagttataaataggtcagaagaatgctttttagtatggggatgaatcgtttacagtagaataattgtgctaacaaagtgtgctgctccataatattgaagaactaaaataggaaaccgaggaggtattatcatgaaagaggtctgggatctatatgattccaaaagaaataagacagggtatacagtggaacggggaaaaactattccggaaggattttatcatctggttgtgagtgtatggattataaacaacagaggagaatttctcctttcccagagacatccggacaaatcatacccactccgctgggagtgtacagggggggcggtcctttctggggaagacagtcttgatggagctctccgagaagtaaatgaagaattagggattattcttaatccgaaagacgggcggagaatttctcggatttgccgggaacaaacacgggatttgtatgatgtatgggtattttatatagatgtcgatatttcagatatcacacttcaggaaacagaggttgaagatgtaaaatgggtgacgtgtgaagagctaatcaagatggaacgaaaaggggagctgcatccattacttgacgttagcagtgtgacaaagaagattattttatggaggaactctatgagaacttcaatatgtggaattgattgtatgaaatgtgaattaaaagaaacatgctttggttgtgccgtgacagatgggcatccttttcatggcggctgtgtgctggcggcatgctgccttagtaatggatatgagcattgtgggaaatgccacaatgaaaaatgcaggcttaaagaacaggtgattgcagaagtttgtaagcttggcattgaagatatggaagaaattaccgggcttaatgcgtgcaaaggatcatatatcaatcttacatatacgttttcgagcggtcagacagttaaactgttagatgatgacaagatatatctaggtaaccagcttagcaaaaaagacagcagtagatactacgggatagcagcggatgagaggactctgatagtcagcgaatatgatgcggatggatccaatgcggaaatcattgtgtacaaaaaaagaaatgtttaaagggcgaacggaagaaaatttatatctgcaataggaagaaaagaaatcccaggatatttttcagctttgataagcggcatagtccttagtgtgctaattgggctttacccaccttgaaaaaaatcttcagccgattattttggcattgaactctattcctccatcaatacctaaccttatcgtactacttcctacatttcatctgtcgtcctaggcagtaataattatcggcaacatttggtcagttttgacggaacaattagtgggatagtattagttgaacaggagggcttttttaaattctgctggtgattgcagcaatttacggaatttttagtggtagtcatataatatatgtttaaatgtaaaacataatattttgttctgatggcgtatttagaatgcccgaatatgagctttgcactgtaaatattatgaatataatgttcgtaaagggtaaaatatgagtatattgcatatgctatcaatcaaggatctctgaaacgaataaaacttaaataaggttgtagaatcagtgggatagctatataaataaggtaatattttcgtataagcaacaggaggatatcaaatgtatgatataattattattggagcaggaccagccggcatcagtgcagctatttatggaaaaagcagaggaaaaaggattctgatgttggaaaagaatcgggttggcggtttgattggaactgtctcaacagttacgcattatactgcaattatgaaagaagaatctggtaagacatttgctgaacgtatgaaagagcaggcacttagtgccggcgtagagattcgttatgaaaatgtgacagagacaaagctcataggtaataataagaaagttgttacagataaaggcagttatgaaagtaaaacagtaattctagcgaatggtggttctggccgtatgttaggaattccaggtgaaagtctgaaaggtatcagattaaatgcaacaaaagacggttttgattataagggtaagaatatctatatcattggtggagcagatggcgcagtaaaggaagccatttacctggctggaattgcaggaaaggtaacaattgtatgcgtggaagatgaactgatatgcatacaggaattcaaggataaagttactgcacaccataatattgaaatcatgccacattcaagtcttacagcagtatatggtatcgaaagagctgagagacttgaatttacagataacaaaacaggaaaaaaacagattgtacaagatgcagagtgcggagtgtttgtttatgctggaattgtaccgaacactcagatatatacggaattgaagttagataacggatatattccagtggatgaattgatgcagacagaaattcccggagtatttgctgctggagatatctgtgtaaaaaaggtaagacaggtagctacagcagttgctgatggcgcaatcgcaggaatacaggctgcagtaatgtgttaataaaagcagccgataataagttgatgttaatttccaaatatatccttagatgtattttagagaagaatttgttataattgtatttgcaaaacattaaataacctcatttaagaaaggagctatgagtcgtgaaaagaaagattgcaatattattaattacaggaatttgtctgatgcatacagtaccctgctttgcatcccagtcggcgatggttagtgtttccaattccgaagaaactcaatataccacgctcccggacgcagatactctgcaaaaagatgtgggattcaagcctaaggccccagaaaccctggcaggcggttatcagtttaatagtggtaatataacagaattatttgatttggatacaaatggcgctcaaatcaacaaacataaaggtataaacttccaatatataaaaaaggacaataataccatcaaatcggtttccttgtctgccgaaccggcatcagggcaatctctttcaaaagatactactgttataaaatatggggaaatagatatgtattatgatacggctcaggctaattctctgtcttggattaatggggaggtttgctacatccttatggacattaataagaatgtgtcaaaaaatgaactggtagctatggctgaagatatgattgattagctatatccattataacaagtacagttaagaggaaaaataagaatagggaataggaattccctactcttatttttttgcaggtcagcagaggctgttctgttatcttaccttaaataaatgcgcccttcacttgaatctctccattgaatatatattttttattatgcattggcatttcgtacagtgaattttctactgtcgtccccctttaattagcagatacacatatggcaattcatacgcgtacgaagaaaaaacgctaagctcatttcacccctataatcaaatatattgtttttaaatccgtaacaaaacctgtcatttgacttgaaagttgcagattatttatgtgtggcagggctgatgacaattcttctacagtgacagtaccgcgaaatgcttctgcaatggctctgagaattacagttatccgatgaagtatttcagctttttttccaatattattattcataattttagtatatattatgttgaatttttctgtcctccatattattattttaataaagtacatgataaatgagacaaaataaaatgatagtgacagtcatagtctggaaacgtaagaagaatattcggctgccaaacagacgctattgtacgttttatacatgaaacataaggcgtttaatagagacatgaaaaaagaatacattaatatgaatgtattcgatgcattgcagaagagatttgagtttttattacctgcaataccaaatatcattatacctgcggcttggcattgcagcaggattttgactggcttgtggatctgccgaaagaaagggtattaaggaaatccaataatgtggaaatcgtctttgaggaacaggattttgacggttttctgaacaagttgaaaaaatacccggatattgaatatctgggagaagtgattgagcatagctggggtcaacgggtgattcggttttacgatttggacggtcatatcgtagaggttggagaggatatgaaaatggtgctaaagcgttttcttgcttagcgtgacaatggaagaaatctctgtgaaaatggacgcttccgtggaggacttaataaaacttatgaacagctaaatttcagaaagaaaaaaatggttttattgactttaataaaaaccacagcaatttcaaaatggaaaaaataatacttttaagcaggtaatatctcatgggcgaatagaaaaaagataatttagagagaggtatttaatatgcaaattaagagaatagatgatacacaaatttctaatgcgattgatttgatttggacaacatttatacaatttgaagctcctgattattcagaggagggtattcagtcctttagggattttattgagaataaggaaataattaaaactttggaattttggggcgcatatgatgataaagagttaaaaggtgttatagctgcaaaggaagaacgaaaacatatctgctgtttttttgtgaaagcacagtatcatagacaaggtatcgggcggatgttatgggaatatcttttaaagaatagtccaagtgaaattattacagtaaattcttcaccgtatgccattcctgtttatcataaattaggctttttagatatggataccgaacaattatctgatggcatgagatatacgcctatgagatttaaacgttaaattgatagttgcggaggaataaaaagatagaatataaagtggacgataaagaaattaatgcttcattttttgtctcttttgtaaattagatatggtaacgtgcttgtaggggggggcgtattctttcggattgttactattttggaacaattacagaattacttgttcttccggaatatcagcagcaagggattggaagtaaacttctttagcttgcaaaggacaaggatagaagacagggaggatgcaggtggtcaaataactgattttacgggaaaatcacttgatccgagaaaaggcagcagtgtagtgggaacaaacggatacgtccatgcggaactgttaaaaatacttttaaatggctaatacctcgtggacaaataaacaaattgcattttggaggagatagaaatggaaactaaacatccatctatgttagacttgttgattgaaacacatattggattggaacgccaaggccccggaagttccgaagccatcgaacaggctcttggatttcttaaaccactaaataagttttcacgaattgcagatttaggatgtggaactgggggacagactattcatttagcgcagcatctacccggtacaattactggcttggatatgtttgctgattttatagagaaattgaatgaaaatgcaaaaagcttgaatttgggaaatcgagtaacgggcattgttggctctatggaggacttgccattcaaaaaaaaaatctttggacttaatttggtcagagggtgcgattgacaatattggttttgaaaaaggaatttcatactggcatgactttcttaaaaaaggaggctttgttgttgtaacatgtccgtcttggcttacaaaggaacagcctgctatcgttgagaagttttggtctaatgccgggagttgtctggattgtattagcaataatatagagactatgcagagatgtggttatcagtttattgcatcgtttactttacccgaacaatgctggacaaacaactattttattccacgtgaagcggcaattaacagactgttcgaaaaatatgccggtaatgaaactatgattgagtatgcggcacaaaaccgatatgaaaccgaactttattcaaagtataatcagcattacgggtatgtgttttatattggtagggctatatagtcatttagtttgtaatattttaataaataaaaagaaccaaggagaaagtataatgattgcaatgcagtacaaagtaaaattactagataattttgatatgaatattattcgtaaacgtgtaatcgacaatgggaggaaaacagatttaattttcaaagcataccttatcgctgtaaaagataaccattctgcactccaatggttggcaaaagataaatattggtgtcccgctattaagtgaaataaaagatgatttcagcacagcgcattttggtttggaagccaaaagagcaattccagtgtattgaaggagagatatgacatttcggaatatattatgagtggaacgcacaaaggggagtttttcagaataacacctacaaacaaggttttggaaattatagataaatcgggattgttacacagattatttatataacgaatggaggtataccattggaaacagtagaattgagatttcaatatactcaaagtgagtatataagagcagaaaggcaatatttaatttatagtaaaaccatacataaatatgatatcgctttagctgctatatttttgttgctgtcggtagtttatatgctgttctcttcttttagtatatttagcatcttaacatttggattagtaattgttgtaactggattgggaagctatttatatattctaatgcctatactgaaattcaaacaaactacaaaatatcatgaggaatatacgctggtattttctaaggaaagcattaaatttaaaacacaaagcattgaatcagaaatgaagtgggatatttactctgcactttgggacagccatgatttttattacttaattcaagcaccacgaatatatacattaattccaaaaagagtttttaaagaccaaaacgaaaaacaaatatttgaagaaattgcacaatcaagagtaacagcaataaagcacgtataattagcataccccacagtgtaaggtaatagagttatttgagaatattggaattacttattggctcgatggtggatggggcgtagatgttttggcgggcaaacagacaagaacccatatagatataaattttgatgctcaatatgcagaaaaattgttaaatgcgcttctggatctgggttataaagtcgatacagactgtaaaccagttgttttgaatgttcagattttccttgtaaactgattaaaaacattgaaaaaagttataacgaaaggtatcaggcaacaataattgttactgtatataataagtcataagaaaataaattaaaaaattaggtttttaggaggtacacatctatgaaggataggattgcatactgcgggctggactgtgaaaagtgcgatgcatatctagcaacaatcaatgacgaccaggtgttgcgtgagaaaactgcaaaacgctgggctgagttaaataatgctcccattctgcctgaacatatcaactgtgaaggctgtcgtgttgatggaattaaaactgtattctgcgatagtctttgcggcattcgccagtgtgcattgaaaaaaggtgtgacgacatgcggtgactgtccggacttggaaaaatgtcagacggttggagcgattatctcaaagtgtcccgaagctttggaaaatctaaacggataaattacatagtttgttgattcttataatcagatggttcacaccaatggaggaaacgtatatggatattcagaaaattatcagcatgctctttcatcggatattcaatttcttggagaagaaaccggattgcaggaaataaaagcagatagcttttggatttagatccggttgacgggactataaaccttatgcacgactatcagcacaacgttgtatctttaacactttgcttggttccgcagggagggtggtcagtgccgggacgtcctcagaattggcctcggctctgctgctttggagctggcatataccgcttgcggcaggcaaaagggctatttcgaggcatatctgaacccctgagattatgttgccggtatgcttttaattcaggaggcaggcggtaaagtaaatgattttgcggtaaagccgcttgaccccagaaaaggcggcaggaaatagcaagggaagtgtcaaactttgtctggggaatgatgaaagacaacacagactcaagatagcttaattgataacttataaggttcgttagagtgatattgacggaaacgaaatagtgatagttgaatttgtgtagcatgaatatgttggaggtgtcggagtatatgaaaagatatattgcatttttgcgtggtatcaatataaacggaaaaaataaagtgcccatggcagagttaaaacaaggttttgaaaaacttgattttggagatgttaagacatatttgaacagtggaaacgtgattttttcaaacgatgaagaagatgctaaaaagtttacaaaccagattgaggtaatgataaaaaatcggtttggcttggatattcctgtttttatcatattaaaagaggaacttgataacatcttgcataatgcgccagactggtgggggaacggagataatgaaatttatgacaatctcatctttattatgccgccggccacatccgcagaggtatatggtgagattggagagcctaaagcggatttagaaaaaataaaggtatacaaagatgtgatattttggtctttcagccgaaaagattatcaaaaaacaaattggtggtctaagacagcaagtgcagctatcagcagcaaattaacgattcgaacggcaaatactgttagaaggatagttggaatgtaatcgtttttcattacagtttgtatgtaagtaacctgacagaaaacaaagaggaaaatttatgtttacagatggcagaagtaaaaaagttgtttttatagcacattgtatattaaatcaaaattcaatatctgacgggacagccgtttttccggcagcttttaaggaggtcataaaaaaatttcttgatgctgatattggcattgtccaaatgccatgtcctgaactttgctgtttggggcttaatagaggaaatgacaatggagcagatgttcctgttgtcattgaaaatacccgtattcgtaaggaaatgcaaaaaggtgaaactcataaattgctaatggtccaagttgattatgtgatgaaacagataacagaatacaatgcctacggttttgagataatcgggattattggtgcaaatcgttcgccaaactgtggtgtggaaaccacatcagattttaataaagagataagtggtaaaggtgttttcatgagcgaacttagtaacagaatacatgagcaaaagttaaatattcctatgttaggcatcaaaagcacggataatgttattaatcaagtaaagtctattattaagtaaaaacaattaaaggataatacaactaccatgttatactttggcgtacaaccggggatagaagcattttttgaaaagaatgactgccaaaaaagcctgcaattttacaccatagaaaagaaatgataattacagcttccagcttatcgggaagttagggggcatctatggaagaaataatgttcagtttaccagatcattaaaaaagagtgaatcataattttgaaagggtaggatataatgaatatatttagtccagaagcagaacagataatgatagagcgtttcggaaaagacacaattatagcattggcaacaacggaaaaggaaacaccttatgtgcgatatgtaaatgcctattacgaaaatggtgcattttatatcattacatacgcactctcaaataaaatgaaacatataaagattaatcctgttgttgcaatcgccggagagtggtttacagcgcatggcaaaggagtcagcctagggtatttcggaaaaaaagagaattgcataattgctgaaaagttgaaaaatgtctttgcggagtggatagataatggacataataatttcgatgacgagaataccatcattctatgtgtagaattaacagacggcctgttgctctcacatggtactagatttgagttttagccattcaaactccactgacggttttgaattaattttcaggccgtctttttctttttataaattgaaaaatccggcatacttccagaccggtataatgtatatgatttaaactgaaaggagtgtcatgctttgcttgaaaaaatacttgttgttgatgatgagaaagaaattgcggatctgatcgaagtatatcttcaaaatgaaaatatggatgtatataagttttattcaggggaggaagcgcttgtctgtattgggagtacagacttcgacctggctatattggatattatgcttccggatatcagcggactttcgatatgtcagtccatccgaagtaaggagtacacatatccggtaatcatgcttacggctaaggatggagagacggataaaatcaccgggcttacactcggtgcagatgattatattacaaaaccgttcctgccccttgaactggtagcaagggtaaaggcccagctacgccgttacaagaaatataatgcgggctcagcgattccggcagcagatgaaatcttcaaatatgcaggtttgacgatgaacattaagacatatgaatgccggcttaatggagagacgctgtcactgacccctacggaattttccatactaagaattcttttagagcgcaagtgcagtgtcgtcagtgccgaagaattattccatgaagtctggcaggaagaatattataccaagagtaacaatacaattaccgtacacatccgccatcttcgtgagaagatgaaggataccggggaaaatcccagatatataaaaacggtttggggggtaggatataaaattggggaaatttaaaaaaacaaaatacaactattcaaagctcggccgtattacatttatcagaggattatggattaccgtgggagcagttgctgcagtctttgccctgcggatgctgacgcgtggacacctggcagatgcgattgttgggtggtttgcacgcagtctttcaatcagtgagatggaagctgatttgttatatatattttgatgaggtagtaacagggattgataagcttatggaggaaagggcagcgatttccctgtctccggaactggagagtgtggagcataaactggccgatgttaagcggacacttgcagaacgggcggataaggctaagagggcagagcagcagaagaatgatcttgtggtatatctggctcatgatatcaagaccccactgacttctgtaatcggatatctcagccttttagatgaaacaccggatatgcccgatgaggagaaagcaaaatatatccatactgcatgggaaaaggcgaaccggctcaggatcctggttaatgagttctttgagattacccgcagtcactcagaatctcttccgcttcaaaagacaaaggttgatctttactatatgattgcacagatttcagatgaattgtatccgcagttaaatgcatgtggaaaaattatagagaatcatgtagaagaggatatatctgtatatggagattctgataagctggccagagtatttaataatatcctgaaaaatgccatttcttatagtgaggacaatagcgttatcaaagtatcagccatagagctttcagaatggactgtgattcaatttgaaaatgacggggaaattccggaggaaaagctcaatgtgatttttgataaattctgccgtttaagcaatgcgagattaagcgaaactggaggctccggcttggggcttgctattgcaaagaatattattgtactgcatggcggacagataaaggctgaaagcagtaatggacacacttctttcatcattgaaatcccatcagcatcatccaaaatctctgtcacagcatcttagcgattttaatacatttaccatttcaatcgacctgatagaacaggcggggaatcagacgattatataatgtcaagtacagattatttgctgtaaatgccaagtcagcccagactgtcacggcagaagcgaaaagacgttatataatagggcttttcgggcacggaaatcaagcggcaagattgtacttttcccacataaacagcgtcctatcgcatacatggccacagcacccgcaacaagaccgggtgctgtggcccatgtacagctgactaatctccatcattatgtggacgctttttgggattctttttatcattgtattttttcataataaccatttttagtaagccaacgacaatcaaaattgcggcaatgataatccaccagtattgctccataacctacttcacttcctttcagttgtattaaatcatctgccccgttctatgcagaatggagaagttcattatcctgccagcttctgaaacagacgttttgtaaggaaataataccagattaaagctgccgccaaagccatgagaaaataaagaaccgcctcattctgcacagctttagctgcccagaatgatggaaggaagccaacagcatactggcagtatctatcaatcaagaatggggctggtattcctagtaatgtaagtgcagccagttttgtaactgccattccctccagtttattagcggaaagggtaatgatcatcagagctaccataatagcctggaccgcccctaaaacggacaagcctaaaaccatgatgacggaccatctttccaatgaaaagattaccatcacaataaatgtaacaaccgttgacagaattgcaggtattccaagccttgaaaaaatatatcctgattttccaagcggagttattgaaaaatacctggaaactttatcatcaatttcttctaaggtaatcatggcaaaagcaaaacaaagaagcactggtgccatgatagaaaggaataagtcaaacatcggataatagggctgtaaagaaaattttgaagctttttctatcaatgggattccaaatttaataagggcgccaaccagaaacggggtgaaacaagctgcaagcatcatgggatccttttttatctgttggaatacctgccctatgctgttaaatacttttttcatatcttcacacctccaatactccgccacatttttgataccatcttatgtgctgccggatataacacaaaatttgccgcaagaaccagaaccaaatccagaaacgggttctggctgtaccctgttattaaattcatgcaggccataaatggaaagaaccgtaaaattttcggcaggtctgtaaataatcctgcaatggggggagcaaagcataaaatctcaatgggcataattacaattaaaaattgattcaggttcgcaatcttcgtggcagccatgataccgagcatagtaaaaatcgatgatgttaatgctgtaccgattataatacctgataggttcctatttcctgccgcaattcccagtatcaatgcgactacacaggatataaacatcagtgaaaataccttggcaaggatgtactcggatacttttgccggcgatatggcaatcgcatggagtaccttttgacttttttcaagtaaaacaatcgctcccatgaagaacagccccatggccgccggatcggaataaatcataatggcggctgcattgtgtttccagttatccggtaaagctgtaatgccgaagacataaatcaccgtcaaaacaaaataaataaagtaaaagccatatttccattggaagtgaatatcgccgcagactaatcttcttaatttcattgcagcgtcctccctgttatatccacgaaaatatcatttaatgttggctcactgctgtggacagagcgaagactattgcttcggattagttcatttagccgtttatcatccgcagtttgtgtaagcatgcattcacccgtcttttctccattttcaaaataagagtaccggattttagcagcgcctcttgacatgataagattatgtggggtatccagggcgctgacctttcctgatacgataaaagcaacctgatcgcacagttcagttgcgtcaaacatattgtgtgtggtaataataatcgtcttcccgcgttttttctcggcaagaataatatctttcatgagcctgctgttggtaggatcaaggccgctggtgggttcatcaagaaaaagaatatccggattgtggaccagggcttttataaagttcagcctggaacgcataccttttgaaaaatcggaaacctttttatcaccgtcattttccagcccaaccattcttaaaagttcttcagtggaacggagcggccggtcatacagggaaccaaagtagttcagattttcgcgtgcggtgaatttctcataacaggtggaaaactcaaaatcaacgccgatacgctcgtaaaatctgttagtcctttcgcggatttccgttccagctactttgacactccctttatattttgtgttaagaccggtcaggactttctgtatggttgatttaccggcgcctgatggccccagaaaaccgaagatttccccccgtcctacgtgaaaactcacattttctacaaaaggtttgtttgtgtagctgaaacataacttgttgacttcaatcatttttacttcctcctttttgaatatatgacgattaataaaatatagtcatatgaagattaaaaaaatgtttggctacctgtcagccaaataaccaaacaagtgctgctatttcttaataacctgttccacgataccatcaactaaaagtgtttgtatctgttctaattcttcatcttccctgaactgctccaggcaggtcaacacagaatatagagatttaatcaatacagtatgaggaacggtaaactgtactcccatttgctgcaacatttccaatatgcggatatcattgtacatatggttactgaaaatatcaggggacaactttcgctgcagataatccattatggataaatcaatctgcgacaggatgggagaagtaatgattccggtaagactcatcataatgacgtctttggttaaagctttttgcgtaggataatgcttcttcttcaccactgtttcaatattttcaaaaagtttctgctgtaattgaaagttgatttcgatatacaggtgttccttgctgggataaaacgcataaaaggagcctttggaaatattggcggcaacagctaaatcatcaacagtcactttctttaatccatgcagggaaaaaagtttttcgccttcggccagtagtttatcactaataaatgctttttccttttcagtaaagcgtggcacttttatcacctccttatgactaaatatttaatatagtcatatagaatataccacttatggcccgcattgtcaattattatctaaagtaattgaaaaaaatgccgcagtaccctagcgatttcctgaaaaaaagcgcattgtgtgataagcccggtaaaaaataagatgatataatgtgaacatcaaatacaggaggtacaacaatgtacgcatgggaagcaatcgaacaatccttaacatttatcgaggaacacttaacagaagaaatttatacggaggaactggcaaatatagccggcctgtcccctttctattttcagcgtttgttcaagcggctggtaagtaaaccggttcaggaatatgtgaagctccgccgcctggcaaaggtgattgaaaatctgggtaataccgaacagagaatacttgacgttgccctggactatggctttacaagccatgcaaattttacgcgggccttcaaggaaacgtatggaatcacacccgaagagtacaggagagatttaccaatgctcaacacattcgacaagccggaagtttccatgaattacgtcttagtagatgaaggggttccgctggtggtaggaaatatcgtcttggaaatccagagaaaaacgttgacgaaaccggaagtttacctcggctttgaaacaaaagtccgtatttctgaacagattccggctggtgaaagcacaggtgtagatgtgccgggacagctctggaaacgctaccatatggagaagacgataatcgcagcagacatcgatacaaatgtagaaatgggaatgtcccatacggaaaatacggcacagggccttttcacgtattttgcgggcggtcttgttcgagatatcccgcataatcagcagggagactttgtaaagagagaactcccggcgggagaatacatcgtttgcaggattgaagcagaaaattttgaggatttggtaacggttgccttgaatcaggggggaaaataccttttcggtacatggctgccgcatcacaacttaacaacggagccattctcagcagaaaagtattatcgtgacttaaaagatatggcctgtatggaaatttggatcaagcccataccgttggaaaaagggtaggagggatattgggatggattggaatatgctttatacaaacggcgatgctccatctctgaagcaaatagcggagtatattgacaatccgttatgggcagagtttgacagccgcatccggtccgcttaccggattgagccttatatggattacagccgctgttccatgcagccaggctggaatattaaatacaagaaaagcgggaaatctctttgtacctgttacccaatgcagggttattttatcgctcttgtggtgataggaagccgtgaacttacggaggcagaattattaatgccgttattttctgactatgtgcagaaagtattcagagatgcaaaaactggtaacggacagaaatggctgatgttagaagtacgggataaggagattatgaataatgtttttgaactgataaatcttagaaagaggagtatatcgccttaggaatttcttaatcattcatttaccattccatagaaaatcaattatctcaaattaaaaaattgcctgctcatcaatggtatgcttaagcttcctgatagagcaggcaatttttatatgaaaggaggtaattttagagtatggaggtggctgtgagaaagaagttaagacggatttttacaataatgggaacaacagcactgatttttaccataacagcctgcgggaaccgcatggatgccatgcagccggattcttcctatgttgcagacttttttgatattccggactcagtgacaggaatcgaaagaattctgctcaaagatgatatggcctatatgtgctgtctggaggaagatggcacgtcctatctggcagcaatgaacattgatgacggtaaatttttgaaacagaatctggagctggacgcctcggtttcgcttctggattttggctttgccccggacaacagtatctgggcggtttgcctggaacaggccggcgtctatagtttacgcggaaagacaacgctgctgcggatggttgcaggacttgagagtgtaagcagcggcgaggttattatggctggcaggattgtgaaccaggttccgccaaagaaccgcgatattgccatggtattccaaaattacgctctttatcccaatatgaaagtaaaagataacatcgcctttccacttaaaatgcagcacatcggcaaacaggaaatcgctgcttgaaaggaagccgggggccttgtccggcggtcagcgccagcgtgttgcccttgcgcgggccatgataagaaaacccggactgtttctcatggatgagccgttagccaatctggatgcgaagctccgcacagaaatgcgcagggagattataacgctccaacgggagttgggggtaacaaccatatatgtcacccatgatcagacggaggcaatgacgatggggacgcgcatcgccgtaataagtggcggtgttttacagcaatttggaacaccgcaggaaatatatagaaatccggcgaatctgtttgttgctgggttcataggctcacccaatacgaatgtgtgggacacagagcttatttcaaataacggacaacattatctgaccctgggaattgcccgtattccgatggataaaagcggtctggccgcaagaggactgcagggacccattaaggccggtatccgtccggaacacattgtgccggctgcaccagacgagcctcatgcagtacggatgaaaatcagcattttagaaaataccgggcgtgaagtggcagttttcctcaccggggctgacataccagatattacgatggtaacaggcgcggatttctcaggccaggccgggcaggaggtatatattcggctaaagccggaaaagatacatctatttaatacagagacaggatgtgcatatggagatgtttatgtatagaatatattcaacagggatagaaactgcggctgcatcaatgatactgataccgatcctttttttatatcaaatatttattttccacaacataaaaaagacggctgcctatattatttttattttatatttgactgcaatgtgctttttggtggggtttcccagtgtgacagggattaaaatcggttggtcttataattttattcctttttatggtatgctgaacgatataaccaacagctatctgaatattttactttttatcccattaggtatatttgttccatgcttatggcccgaatacagaagcatgatgaaaacagtgggcttgggcctgatgacatcactgggtattgaaatactgcagatatttacctttcgcgcaacagatataaatgatgtgataacgaatgtggcaggtacaatgataggatatttaataggcagattgattattaaacggtttccacaattaaactggcttggctgcaaggaacgtgagttatatcttttatatgcaacggttgtcgtagtaatgtttttttcccagccgtttattcagtctgtattaggtaatttctctttatagggaattgcctggcagcacaggagatgttaaaatgataaaaaacaaggaaagggggaaacacaggtgtgtaaaccgtttagggaggtagcatgaaaggattccatcgacaaaataaattattttctctctgtggattgaattgtgggctttgccctatgtatttgaataaaaattgtctcggttgtggttgtggtgaggaaaatcactcatgtaaaatagtaaggtgcagtatggaacataacgggatagagtattgctttcaatgcaatgaatacccctgcgaaaaatacgagaagatagacaaatttgattcttttatttcacatcgaaaccagaagagcgatttagagaaggcccgccagattgggattgaagcttacaatgcagagcagaaagaaaaggtagaaatactgggcactcttcttgcaggatataatgatggccgtaaaaagaccttattttgtgttgcagtaaaccttctgcagattcatgaactgagagaggtacttggaaaaattgagaacagatccgatttggaaacactgacgctcaaagaaaaaagcacttttgctgcatggttgctgaaggcggcagcagaaaagaataatattgacttgaaactgcgaaagaaaaagtgagaatttggatacagacatcgttcattaatggatagtgaggaattgagaatcgaagtgagttcatcgaaatgtatccggttcttggaaaggacagaagaagagaggtgtatttttggtaagagaatatctgcatatgaatgtttatgatgcgtttttagcgcggatgcattttctctttgaggagtttgatcatatctatgtctctttttccggaggcaaggacagcggtttgctgctcaatctggttctggattatcggaatcagcattatccggaaagggccattggcgtgtttcatcaggactttgaggcacagtatatggtgacgactgagtatgtggaacgcacctttgaacggattaaggatcaggttgagctttattgggtctgcttgcccatggccaccagaaccgcattaagcagctatgagatgtactggtatccatgggatgatacgaagaaggaactctgggttcgggagatgccacaaaaagaatatgtcatcaatctggaaaataatagaatgactacatatcgttaccggatgcaccaggaagatttggcaaaacaatttgggcgctggtaccgggacgcccatgacggcggaaaaacagtatgcctgcttggaatgcgggcagatgaatctttacagcggtacagcggttttttaaataaaaaatatggctataaggatacctgctggatcagcaaacagtttaaagatgtctggtgtgcctcccctttatacgactggtctacggatgatgtatggcacgccacctatttatttggttatgactataaccgcctgtatgatctctattatatggctggactgaagccctcgcagatgcgtgtggcctccccgtttaatgactatgcgaaggatgccctgaatctataccgcgtcatagacccggagatttggtgcaagcttgtaggacgtgtacaaggcgcaaatttcgcttccatttatggaaagagcaaagcgatgggctaccggaatattactttgccagaggggcatacgtggaaatcttatacgaagtttttattggatacactgcccaaaaggctgcggaataactacgctaagaaattcaatacctctatccagttctggcatgggacaggcggtgggttggacgagtctgtaattcaggagcttcaggagaaggggtatcaaatcagacgaaacggtgtttccaattatacattgaaccaaaaatcacggattgtatttgtgggacccataccggatcacacagacgatatcaaatccacaaaggatatccccagttggaagcggatgtgttactgcattttgaaaaatgaccatatctgccgcttcatgggatttgggatgacacggcagcaacagaaacggttggatatgatacgccgtaaatacaaaagcatagaggaatttgattatgaagtataaaagcccagtttataatgtgatagctgttccaatagagaaggtacggcccaataactacaatccaaataaggttgctccgccggaaatgaggctgctttatgagagcatcaaagaagacggatatacgatgccggtcgtatgctattatgtaaaatcgcaggatatttatctgattgtggacggtttccaccggtatcaggtgatgatggatcatccggatatctacgagagagaacaaggattgctgccggtttctgtcattgagaaaccgattgataaacgtatggccagcaccgttcgccataacagggcacgaggcactcacgatgtggatctgatgagcaacatcgtaaaggaacttcatgagtttgggcgatcagacgcctggatctcaaagcatttgggaatggatagagatgaaattttgcgtctcaagcaaattacaggtcttgccgctctattcagggatataaaatttggagaggcgtggtgccctgtagaggaagagacgaaaaaagagtcaataatatagatgagtgaaagtataaacgccctttggcagaaaaataagtgatgttctgcaaagggaatcagatattaattatggaggtatgcttgcaaatggataaatggttcacgattgatcagattgatgaaggtacatatattatcagcgaataccggcattgggaggagacgcattgctatctgttaaatggctccagccgcagcttattgattgatacgggtctgggaatctgcgatatttatgatgaagtagtgaagctgacaaataagcctgttacggccgttgccacccatattcattgggatcatattggcggccataagtattttccggacttttatgcccatgcggaagaattgagctggctgaatggtgagtttccgctgacaatagaaacaatcagagagatggtggcagaccgctgcgatttaccagacggttacgatacaggcacttatgagtttttccaggggacgccaactaaggtattggaggatagagagaacattgaattaggtggacggaatatacaggtattgcataccccgggccatgctccggggcatatgtgtttctgggaatcagacagaggttatctgtttaccggagacctggtttacaaggacactttatttgcctattatccgtcaacagacccggacgcataccttgcttctcttgaaaagatttcggagcttccggtcaaaaaggtttttcctgcgcatcatagtttggatattcagccggagattttaatcagaatgagaaatgcgtttaggcagttacgggaagatggtaaattacatcacggcagcggtacatttgactatggagattgggcagtatggttataaaaaaggaagcagtataatttcatttagttgtgtgctatacaaaaggctttatcagaaataaagaacggctatagattgaggagcgtttatatgaagtatgtatgtacagttatatcggtagcggacatcagcgctgcaagaaagttttatgaggaactgttcgggttagaagtctatcaggattacggaaggaatatcgcttttacctgcggtctggcattacagcaggattttgactggctggtaagtataccaaaggaaaaggtactgaagaaatccaacaatgcggagatcgtctttgaggaacaggattttgatggttttctgaataagctgaaagcatactcggacatcgcatatttgggagaagtcattgagcatagctggggacaacgtgtgatccggttctatgacttggacgagcatctcatagaggttggagaggatatgcagatggtagtaaagcggttccttgcttctggaatgactatggaagaagtatctacgaaaatggacgtatctattgaggatttgacaaaacttctgaataacgagaaaaaataaaattttcaaatatgctcaaaaacagaggaggataaaatgccatatacatttcaatcagtgaaaagcatggaaatattaacagatagcagtaaactatataatttcattgaagacttttcagattatggaaatcagttttcactcatatgcggtaaaatcaaagcgctatttgatcaaccgatttatgaaacgaaaaatctggagaatcttttttcatactgtattctggcgacatcggaagaagcggaagaagtttacttagatatttactgtgcaggctcaggtcttgcagttggcggtatatcggacgaaaaatccagaaaggcagcaaaggctttagtagattatgttcaacaagcaaaagcgattgactacgcacataaagcttacaacttagacggacctactgctcttgaattcggaattaaagatggtaccccttattataacgaaacagagttaagtctttcggagaaagaatttaaagaactgtttttcaatatgtacaaaaacggggatgcaaaataaaaaatgatatgctgaagaatttgaatgggaaattggagttatcggttttctgcgcgggaatcatacagaatgagactatgattgagtatgcagtacaaaaccgacatgaaacagaactttactcaaagttcaatcagtattatgggtaatgattgcatactgtaggctggattgtggaaaatgcgaggcatatcttgcaacaatcaatgacgattaggtgttgcgtgagaaaactgcaaagcggtgggccgagttaaatagtgcgcccattttgcctgaacatatcaattgtgaaggatgtcgtgttgatggaattaaaactgtattctgtgatagtctttgtgtaatgcgataacttcaggtttgacggtaagtgtaacacaacagaggtctagaggggcatctcatagaggctggcggggatttagaaaagctgccgtgtagctgagcgggaaagaaagtaagaagttgtgtggcttgaaaattgtaagttgcttttatgcgttcttggcgtaaaaaggtgtattttaaattgaaaggatggtcgggtactattgaaagaaatcatcaacttcattgaatcgaatgtggatggaaaaacgctgtttacaaaggaattagtttacgaacttgaaaatggtgcgttacagggcgtttactcagatcaaatatctttctctaatctaaaatattctcagagcggttttcagttggatatgtttattgtatctaatgagaagatatggctcatgggaaaggatggagaacgggaaaaattgcgaaaagatttcagtggtgtatccctgttccgatttgaactagcggagcgaaaaagcaccaatagtttgactggctgttttcgtttcatttcagcttcagggaaaaatgtggcagcagaggctatcgtaagtggaatttatgatgtgcgtcttgaaaatgatgtgctgaagttatcggaagatcaggtcttgtatcgggatcagccgatacaagaaggacattttaagcctgttgcatttcaatcggaacatcgtttttatgttaaagctaataagctacactatgaatacaatggcaagtgttttgatgtggactcaaaaactatgcggcgtaacgatagctccgatacctttcctccatttatttcaagcgaaaagtaagaaatgacgaatcagtttgacaggagcgtagagatggatgttaagaaattttggaatgtagttttagggcaaggtgcagataagatccggccttatttcaagtaaacaacctatataaattggcattgcatcattgagcatttttccgttgaaaagttgaacccagaattccccatgaaatagtcgaagcggttgcgattctgacgcatgatgagtctgttaaatattttgagtatataaaagggattaaagtaaatcctgttgcattaaaagtcaaattagcaggtttggctcacaattcagatggcagccgatggatagggaccatgcacattgtagaactggacttcaattaacgaaaagaaaggtatttgaaagcaaagtaattttattaaatacgctaccttaaattagataatgagtatttttcaaaaaagttggcttataacaatttaacaaatcgggattttcagaggtgaatggaatgattcatttggaaaagataaatggcaaaaatgtctgggatattctaaagttaaaagtctcagatagtcagaaatcttttgttgctggcaatgatatcagcattattgaagcgtataccactattacagccaacgggtatgcttttccgtttggaatttatgaagataaacatccggtcggctttgtgatgattggttatggcaaagatgattattggaaggatgcacctactatagcagaaggaaattataacctgtggagattgatgatagataagaactatcaaaacagaggatatgggaaaaaggctgtagaacttgcgttaagatttatcagaacatttccctgtggtaaagccgattcctgttggctgtcatatgagccagagaacacgattgccaaatcgctgtatgcctcttttggatttatagaaaccggagtaaaagatggagaagaacagattgccgtattaaagctctaagacaacttcaggtttgttggtgagtaacacaacagagatctggatgggcatctcatagaggttggagagaatatgaaagtggtggttaagcgttttcttgattccgccctgacgatggaggaagtctctatgaaaatggatgtggtggaggaataaacaagtcgatatttgaaaggataaaattaaaaatgatttcttcaatttttaacagacgaagcacacggaaattcatggataaacctatatctcaaaaagatattatagatattatccaaagtggaataaaagccccttcttctaaaaatagacaaccatggaagttcattgtgatacaaggaaatgctaaggaagacatgataaatgttttccggctgggaatcgggagggaagaaaacgatagcgcattgttaccgcaaagcagacaacacatagcttctgcaaaatacactattgatattatggcagaagcaccaactatagtctttgttgttaattcactggggaaaagtattatggaagaattaacaacagaagaacgtgtttatgaaatctgtaatattcaatctataagtgctgctatacaaaatatgcttctcaccgcgactgagaagggaataggtagtctttggatatgtgatatttattttgcatatccagaactgtgtaagtggttggatagtgacggacaacttattgcagctattgcatttggttatccaaatgaatttcctaaagaaaggccacgcaagaagattgatgatgtagtggagtggagaaagtaatttgtcagaataacaacttccagtttgtagaactggaaaatttgaattgatttatctgcaatgaatatgaaaacaaaatggacagaaaccatatgaagataacacaaaacttaatgcgggtgaaggaacttttgcttaacccacccacgttttcagataatcaggcccgactgcaaacaaatctggatactgattttctcaaactaatcgctatcgtttcaatgctcatcgaccacattggtagcgtttttttcccggaggtaagggtgctgcgttggatcggacggctggcgtttccaattttctgttattgcatgacagtaggactgctatatacccacgatatcaagaaatatttattccgtttgggaatttttgcactgatttcacaaccctgttatatccttgcttttcatccgtatgacttttgggcgcagtttactaactggaatattttcttcactttgtttctaagccttttggcgatgtatggatggaaagaacgcaaatggtggctgttctcactgacctttttcgttatttcatggtggaacttcgactactccagcaccgggatttttttgatgctggtgttctatctctgccgcaacaatccggtagtaggggccatgttctatctgctgtttacagttccgccagcgcttctcgtccactccggtgattttcggaatctcaccttgggtggtcttacaatggattggacttttgcaatggcctttgccgctttgtttatcttcccccgtatctatacaaacctgaaggttccacgttggttattttatgccttttatccaattcatttgctaattattggtctagttcgactggatctcaaggtgtaatgttaagctttgtcaattcgtgtttggtgagttctttcaaaccgtatcttcttaaccctttaaattaataagcatggtttgcaaatctctattttgcaaccaggtatttgatgcctatggaggaaacgcatatggatattcagaaaattatcagtttagtaacaaaaacgcaagggctaattaaaaaccgtgaaatggccgctcatgtaaaagagaaaggtcttgcagattatgtaacgcaggtagatattgccgtacagaatttcttaaaaaaggaactgtttgccctcgcgccggatattcaattccttggagaagaaaccggattgcaggaaataaaagcggatagcttttggattttagaccctgttgacgggactacaaaccttatgcacgactatcagcacagcgttgtatctttagccctttgctgccagggggaaattattatgggaattatatacgatcccttccgcgatgaagtgttttctgcaattaagggaaagggcagctttctaaatgggcagcccatacatgtatcaaatgcagaaaaactatccgatacaatgattgggttgggaacagcaaaaagagaagtggccgatgaaaattttgcccggttccgcagggtgtttggtcagtgccaggatgtccgcaggattggctctgccgctctggaactggcatataccgcctgcggcagacagggaggctatttcgagatttacctaaatccctgggactatgcagctggcatgcttatgattcaggaagcaggaggcaaggtaactgattttacaggagaaccgcttgaaccgaaaaaggggagcagtgtggtgggaacaaatggatttatccatacagaactgttaaagttactgtaagctatgtgttcacttgggtaccctgatgtaggagaaggttagcttctgggtatcatcttctcgaagcgaaaaatcagaagccagtccagaaagtggtggaactaacaatgttctattcaattctcggaaaatgcggacttaaatgtggaggcggtttacccattgcaagagccgcgatcatcctatcagtcatggctaatgtaactttagataggataagattctagctgctggtagtcaggtgctttgttgtgtggaaactattctgttcttagggaggaggagaattataatagagtactggagttcctttgagtctcatttcctttgagaatttgaacagatagggcctcgttgaaaatcctatagtatactgactaaaaaatgtgatcagatgactattaggataatttattaagcctgagcgaattatgagaccgtgtgcagttaaaaagttatgatgattatctaaaattggcttaccaaagagcaggctggtaatctgtttttggaggcgttatgaaaggctttgagagacaaaaccaactgctatccctctatggattgatttgtaggctttgcctatgctattaattaagaattgtcggtattccttacgtgtgttgtagaaaaggcagtgtatcaaaaaacaataaattagctgatggtctggactcttcaagtacattacctctttatggatgatggacacttttttattaagttaatatagaaccggaaattaaacataaactattatccctaagtataaaggtatataacttagagaaaggaagagtagcaaagagccaaagacttaaagaatgcaatatagcaaaaagccaatatcaacaattctttttaaggggaacagtacaaagctgttcctcttttgtttgtgtgccaagcatggcactaatcttgctggtgaaagtccagccacgggtttttaccgccaagtgtagcgaatcacaagtcggtatcagtaatgatatagatggaggaagtggtgtagcaaagttcttgagcctacgaacagaaacttgataaggcgattaggtggggaaggctgcaaaacaagccgaagcccaaatggtaaacgtaaaccgaagttgtaaatcaagaggttgtggaatgaaagattagtgtcttaccttgggagaccctacccacatatcgtaagatatggtcgaaaaaggtttggggagggagtcagatgaagtcatagtaggggtaaaagccgaaggactgaaacgatttatagtacgaatcgttattaagagaattatgcattagccagaaatcagatggactggaaaagtaggaacgtaaccgaggaatactgtctggatcgagaggggtgatgtgcataaattttgtgataataagaggagtaacaacaatggaattaatagatgtgattacatcaaaagaaaatctaaacagagcttataagaaagtagcagcgaataaaggggcaggtggagttgacggaatgaaagtcgaggaacttggtgcatacatcaaaggaaacaaagaagaaattgttcaatcaatcagaaaccgaacctatatgcccaaaccagtacgaagagtttatattccgaaagataatggaaaaatgaggccattggggattccaacggttttagatagagtaatacaacaagcgattgctcagccaattatagatatttatgaagaaatattcagtgaatttagctatggtttcagacctggaagaagttgtcatgatgccataaaataagcactggagtatctgaacgagggatatgaatgggtgatagacatagatatagagcaattctttgataaagtaaatcatgacaaattaattcaaattcttagagagcaagtgaatgacagtaccacattgcacctgattcggaaatatctgaaagcaggagcaatggaaaaagggctggaaaaagcaacaataagcggagtgccacaaggtggtcctctgtctgttgtgctgtcaaacgtatatcttgataaattagataaggaactggaacaaaggggacttcggtttacgaggtacgcagatgacacaatagtattcactaaaagtgaaaaagcagccaacagagtaatgaaatccataacagaatggatagaaagaaagctgttcctaaaagttaatgttacaaaaacgaaagtagtcagaccaacaagaagtaagtatcttggcttcacttttctcaaacatggaggggaatggaaagtaaaacccacaacagaaaagaaaaagaaactgaaacagaagctaagtgaataccttaaaagaaataaagcgattgcacgaccgctggctgaaacaattaaacgagtgaatgaaatagcgagagggtggattaattatttcagaatcggaatgatgaaacaatttgtggaagagtttggagcatggctaaggcacaagatgagggtgattgttctaaaacaatggaaagtgcctaagagaatatacaaaaatctgtgctatttaaaccagaaatataagtgtggattagaccatgaagccatatataaggtagcaaactcaaggctcggttggtatagacgaagcggaatgaatgttgttaattatataatcagtccggaagtactggaaacaagaataaaggacgtagcaggactgctcaatcctttaaactattatctaagaaatgttggaatataggttgtagagccgtatacgagacccgtacgtacggttcaatgagagggaaataacactcgctgttatttctctactctattcaaaataacagtatacaccctcatgagcaggggaatatataggacaaaggcccgtggcccaccatagtctttctgaaaagagataattctacattcggagggactatgaaagtgaaaaagaaagataatatcagataccgttttacggggtatgtattagcagctttaaaacgtgccaagagagattacatatgccgtgaaataaaaataagcaatcatgaaagcccgttagagaagctgcttccagaaccgttgtgtgatataacggacagtaagccatttttatgggaagaaacggagcagattccactgataccggatgaagttcgtcagtatatggaaagccagattggtgagtcaggagaaacggcgcttgatgctctgacagatatggaaattcttgtagtgtttatgaaggtttttagacagctgacatatcaagagatcggcaggcatttgggcatggactataaaaaggccggctctgttttcaactatgcgaagaaaaaaatgaggaaaggatggaaaatacggaatgaattttaaagaactgttaatgaaggctaagcagggagacaagggggcaagagaggaactgtttttgatgtaccgtcccatggtgttaagcaggtccagaatcaaaggaatattttcagaggacttatatcaggaactttctaagacctttgtatcctgtattgaacagttttctattgaggggactgaaaacgagcaaaagtaagactgaatttccttcttaattcgcagttaacgacaggaggaccagcaactatgagtctttaaggagacagagagtaagggaatacagcatgcagaggcagaggtattcccttttcctttaatagtaattatctttatgtatactgctacatttatttcaagggtatctgatacttgtcccttaagcagcttaatagcaatagggggagtcaggaccataataaagactagacaaacactaagaagaattatctttgtgcctctaaaacctagctttacacgctcatttttacgtgcaacacaaacagtacgcctgtctgaatcggcagacaacttaatgagtcagcgctttggggaataggaaagccgcccaaaggcggctcctagctttcagcattttacaaaatagtagaactctatgtcatctatcgtaatccacacatatggattgcccaatatgtcccttacaccgtttacaacctgtgtgaacgcttcatggaatttttcataactttccacttcgactggattccatataattataaagttagcggtcaaaccatccaaatcaggtcctcgtttatccccacaaaggaaataagattcgcttaaccatgcatttacatatatgcctgtactcgcgtatacttttttggcggcccttccccaaatcttaaccaggatgttctgagtgacgatttccggtattagtcccgctatgacaacggtatatcgttttgtacgcatatgaatacccttttttattagtatattcagtaaacaaagaaaaagttattggttatggtttcgcagccagtttatggcatttgatgcgtaaagcgcactgcctagggaaagaatctcctcattaaatacaacgtggtcattatgcatcggtttgccgaatagcggattttcctctggggttccggcgcctattaacatatagcagcatggccgctcataagtataagaggcgaaatcctctgatcccataccgccttgtgtaaacaatactattttataaggctcatagcattccttcatgtagttggcaagctccttgaccatttcactgtcgttttgcagcggtggtgcggaagcaatttctttcacacaagcttgtccgcgaaagagagaagctgtctgaatggagatttcttcaattctgtcaaagatatatttggatatcttgaaatccattgcacggatggttccctccagaatcacatcttcagggatgatatttggagcttcgccggcagaaaacctgccaatggtaagtgcggcaggttgggtgggggcaatttctcttgcgatgatttcctgaagagacagataaatatgggccgcaatattgatgggatcaactccggtttccggcattgcaccatggcatccagtaccttttatatggatctgaaataaagtacacccagccatgcaggtgcctgaaccacacataattgttccagatggaatgccggaaacaacatggaaagcaatgcctgcatctacatggggattttccaaaacgccggccttaagcaatgcctttgctccggtgaatccctcttcgtcaggttgaaataccagtttgacggttccaaccagatcctgatggtattgttttaataatttagctgcgcccagaagcatagttgtgtgcatatcatgtccacatgcatgcatatagccattttcggatgcaaatggaacaggggaagattccttaatcggcagagcatccatatcagcgcgaagaaggattgttttgccgggctgctttccagatatagtggcaataacagcactttcgcatattttctgaggacaatatccatactcttccagtttactaaaaacaaatgattgggttcgtggtaagatgcaacctatttcaggatattgatgtaatgttcttctgattgatattagttctggctttagctgttttgcagactcaaaaattgatttcatattaatatcctccgggttaatattgactgaaatttaagaatatgaaaatggtttgtttcatacgtttctgttaatgaagtatatcataaaaagtgaaaagaatgtaaagtcatatgataaataaaacaatgaattaagaaagaaatgtttctggaatagtatgtataaatagcacgagttgtatgcgagttggagccgtattcagcagaacatatgaataaagggagtaactgggaatgataacaaggaggaaggggggatagaatgctgcatataaatgcggatgattacaagaaaagtaaatattgtccgtctgatgttggagggataggaggatttatatcaggaactgtccaagacctttctaaactgcattgataagtttctgattgatatcaccgaataagaaccaaaaagagactgatttgcgtcctgacatgaattgacttgcgattttcaatcttttataatggtatcatcggatttgaaaatctggatagagaaagcagctggtccgccggctgctttttctgactcaaaaaaacaagaaaggtggtatatgcatgagggaagacagtgaaggtcgtctggcagaggaggtgcaggagagggaaaagcgtggacatgtccatcaaatgggaatccttaccgtagatgcttccggagcagcggcaaggcaggagagcggggatataacctggcatgaaatggtgaatgcctaccgcacaaagaaaatcctgtctggaggattaagtggtatcgagcgcctggatggcggatgggtagtagcagtcgtctactataaagattaccgtgtattaatccccatggaagaaatgatgattaacttggagggagacggaagagaaaattccaatacgttaaaccgtcagacccgtcttgctaacaacatgctgggcgcagaactggattttataatccgggagatggaggaaaagtcaagaagcgtggttgcatccagaaaagaggcgatgcttcgtaaacgccagcagttttacctgggacaacaggagggaccccctatgattgtgcctggccgtgttgtggaagcgcgaattattgccgtggcacagaaagcgatccggttagaggtctttggcgtggaatgctccttaaaagcgagggatatgtcctgggaatggatggcagatgccaatgaaaaattctccatcggggatgttgtcagcgtgatgatgaagaagatatccggagattcgattgagaatctgaaggtagaggttagtgccaaagaggcaaagaccaatgtcaacaaggaaaatttaatgcgcctgcgccgccagggaaaatatgtaggaaaaataacagatgtatttaagggcacctattttatccaactggactgcagggtcaatgcggtggcacattcctgtaatacagccagccttccggggcagggagatgaggttggctttttggtaaccagaattaacgatgagcgggaagtggcagaggggattatcacaagaattattaaaagaaaataggaattttgtacctgagacagtaccagatgctgtcttttttatttgcacaaatatgaaaggagttttaatatgctgaaaggaatcgtgaaatggtttgatgtacggaagggatttggatttattacagatgaggacaacattgattattttgtccattattccgaaatccagggagatggttttaaacggctgaaggaggggcagaaagtgaactttgagccaggggaggatgacaggaaacgaagtgttgcattatcagtgacagtggaggagcaggaatgaattggcgaatcaggatgaaaaagcggcatgccttgtttgttttggttgccacctgttctgctatcagctatctatttggctttatagcccatgcggagacagtcagaggtgaggaggggaggtttgagacaggagatacactggaggttgagactggcctcggtgatggatacagcacattgggattcacctgtctggatacggattaccggggtggatatctgtttgtgtcggatgaggtcattccctactccctgtgtgtccgttatgcggcttccaataacgattatacctactcggatgtcaggacatggcttaaccagcagtttgctgataccttgtcagtatcaggggacctgctccccgtaaagctttcagaggctggggattccatatcagaccgggttttctgcctgtctgttgatgaagtaaagaaccctgcctacaaagcgattaccagaaaaatctggacaccgcaaagaggaatgcgctactactggaccaggtcgcctagagagaacacgacaaaccaggcctatatggtgcaatacaacggacacattgcttccagccgggtatcattaacagaagccggggtccgcccggcctttgtcatacagaagggagaaccagataatacacagggcagaatctggtataccggggatacgatggaacggtcaattgccgggaaatcatataccttccgctgtattgacccggattactgtgatgccggaagtaaccggaatggagcgctgtttctctgtgacaccattattggtggaaacgaaagcccttttgacgggagggaaaatgcctgggaagcgtctgatttaagggcatggctaaatcaggaattggaggatagggaaaagcttgcggaaacagttacaacctgcccgtttacctatgcgggaaaaagtaataattaccagatttcagcccggagatttacaaagcgcagccgcccaggagttaaagtcacggaccagatattctgcctttcattggaagaagcgctccggtatccggatatcttatggaggcttggtggtgcagaagagaataattttataaatgcaggaaccttcacggcgggctattggctgcgtacacctgcggccggcgatggaacgaaggggtatgctgttacctatgacggccgggtggtaccggaggatgtaaccaataagaaaatcggtatccgtccggcgtttgtggtagttcaggaataaaaagagttgcttatagggaattttctgagaaaaaggagaacaagatgaagaaaaagatgaagaggggacaggcggttctgtctgcatggaccttgattgcagcgatggggttaactccggttctttctgtatcatatccaaacggtatcgctaccttttatgcaaaggaggccgttaacgaggcggtagaagaagccggtagatgatggaacgatactctatcatcaggaaaagaaggtgtatgaatggcagacagatgatgcaagtgatgtgagaaaaacggcccatcaggttaccataccgggtggacacagctacacggcctatgattatgagatagagcaggttccgggaaccagtcaggcagtttgctatatcacggagacaggagccatacgttttgagtatcttccggtggggaaatatgtgttggtagaagagaaggctccttacggctatacagtggcagcaccggtttatgtaccagtccttgatgtgggttctaaggaacgggtgcagaccattaccatgacagacgaaccgattcaggtactcctgacaaaagtgaatgtgacaggtggaaaagaaatttccggagccacagttgccgtctaccgtgcaaaggaagatggtacacttgccaaacaccaaatgaaagacaaaaacgggaatctgttgtatgtaaccgatacggacggcaatctgttgcaggatgaagatgggaactatattccggctatggagtacgaagaggcgtatctggtggaacgctggatttccggctcagacggaatatacacgaagcgggaccagaaagaaggcaggataccggaaggttatgaaatcggggatttaaggcttcatgagttaagtcagccggccgcagggaattactattttgttgaggaacaatctccctttggatatgtgagggctgcagaactgccgtttgcgattgttgatacattggaaattcaaaagattgaactggtaaatgacctgattctgggccaggttgagattatcaagaccgataaaaggaatccggaacaagttttatcaggtgcaaggttccgattgtccaatctggataccaatgtggcgaccattctgataacggattctgatggtcgggcaatcagctccccggtccccattggagggataggaacggaggggacggtaagcctctatcatttccggatacaggaggtggaagcgcctgacggttatctgcttgacccgacagtccacgacttccagtttaatataaagacagaccagtaccagacgctcacctatcagtatgaagcagcggatagccctaataaggttatcatttctaaaaagcagcttacaacaaaggaggaactgccgggcgccagcttagaggtccgcagagtcacagagatggttgacaaggacggaacggttatacggattgacggtgatgtgattgaaagctggatttccacggaggtcccgcacgaactggaatgcctgacagaggggatatatgtcctaatcgagacacgggcaccggaagggtatatagaagcagagaaaatgtactttacaatatccgggaacatgacagtggatgacatccctatggtggagatgtttgatgatgacaccaagatagaaatcagaaaggtggacagtgaaaccggagcgattcagttcttcggtctcccggcaggcgtgtacttagtgaaagaggtagaggctccggaaggataccagataccggaaggtcccatgcggattaccgtgaccaaagattataagcaacagacgtttgtaatggagaaccggatgaccgaattgatgattgacaaactggacgaggagaccagggaaccggtaacaggagcagtgctgcagcttacagatggggaaggaaatcaggtggcgaaatggattaccactggggaaccggaactaatccgcggcttaaaggcaggctggtatatactggaggaaatccaggcggcagacggcttcctgtttttaaaggaaccagcgagaatcgagattacggagaaagcaggaatacaaaccgttaccattacaaaccggaaacttgaagtggaagtggcaaaaacagataaagagaccggagaaaacctggcgggtgcaagacttcagttgattcgagatgccgatggcatggtattgaaagaatgggtaagcgggaagatgcctgaaatttttaaaggactttctgccggagactatacaatcagggaactggcggctccagagggctatgcagtaacagggcatttaaacttctgcgtgagtggaaccgaggaaaagcaggagattatcctggtaaatgaaaagattgtggtggaactccagaagacggacaccttggaaggcagcccagtggaaggggcggttcttcagcttctaaaggccgcggggacaaacgaggaaactgtaatgaaagaatgggtgtcaggaaaggagccacttattctaacaggaataccggctggtatctatacaataagggaaacacaggcaccggaaggatatgtcccaatgaaggatatgaaaattgagatccttcctaatcagaccatgcagcattttgatattaaaaaccagccaattcagatagagataggaaaggttaacggagaaacaggaaaactgctgggtggcgctgttcttcaactggtaagagattcggacggtacagtaatccggaaatggacaaccagggacggtgaggctgaacactttaaaaaccttgcgggcggtacgtatataatacgtgaggtgaaggctccctccggctataagaaaatggagccgcaggaaatagaaataaaagatattgaggcgatacaggaatttgtggtcaagaactataaactcacccattcaggtggcggcggtggcagcactccgaatcacccgagaccctcagcggagtatatggaactgtttaagattgatggaagaactggacagaagcttgcaggggcaaagattaccgtttacaatccagacggcagtgtctatgcggaaggaattacaaattcagcaggaacattccggtttaagaaacctttaaaaggagcctatacatttaaagagacggaggcaccagagggatactatctaaatgaggtactgcatgcgtttgcagtaactgacgatgggaccatagaaggggatacgactatggaaaactacagtaaaacagaaatgataatctctaaagtggatgtaacaacagcagaggaactgcctggcgccgagattgaggtcacagaccaggacggaaaccatatcttctccggcattagtgatgaaaagggaaaagtgtattttccggtcccgtctccgggggagtatcatttcagggaactgacagcaccggaagggtatgacagaaacgagacggtcttttcattcacggtgtttgaggacggcagtataattggcgacaataccattaccgatcagaaacattatggaacaatcacggccagttatgagacaaatagaaggggagagggtgatttgacggtcggtgaacttaatcatgcaccaaagacaggagataccagctattttgtaggggtgttcatggcatggcttgcatcagtagtcagcctgttaattgtttctctctcaaagtggagaaaaaaacaaaagaaatcaaaaacagggataaaggctggcatgtttctattgttggcaataatggcagttagtacgccggtgatggagactcaggcagcggaagatgtaattaaaaatatatatgaggaacaccagtatacaacggaaaaccctgattctaatgaagcagaaaagctgtttgaaaaagaaattgagagagacggaaaaaaataccgtctctcagaaatccggacagaagtactggaagaacaggggaaaaggaattctggaaattcttttgaaattgcaacgaacccgtttcttgatggaaaagtggaggttaggccggaagaacagataacccggaatggaattacttatcatttggtaaaatcccagaaggaagcagccgttatacgggctcatgaggtaccggtaagtgaggaagtcttatatgaagcagtggaatccaaggacatgataccgtcaaaaatcaagatgacggtaacagatgagaaaaccgggcagatgatggagactattgcaaaaatttctggccagacatttggcggggagcgcctggatgatacattttccttttcagccgtgttccatgaatatgggctggacgggtattggattggggaccaggtttttaaactgagtgggactgaaccagacttcaccggatatgaagggcagctcctttctctgattgaggctgatgctgagcattataccatagaagcagcaaggtgggatggggaagcttacacagatgaagcgggtatcctatgccggagggttgttataactggtaccaagaaggtgagtgactgcacagtgatgtatgagggaagtgcctattttccggaggaggaaggggtacgcctgatttctacctatgatagcggagaagaaggggtaaagcaatacaccatgaaagcaacgggggtttacatacctaaaaagaaccatggagcagtggtcgccaccgtgattggtgttaccagtgttggtgcaggtactgcaggatatacctattatcggaaaaagaagcagaatcaaaacgtataagcaacgaggggaggaatgggacatatttctccccataaaaaaattatgaaatgcccttgtattaaggattaaccgttttatacaatagaactatattaaggaggaaggagatagaagaaatgaaaagaaaacagaaagtagtccggatacatccgcgtaagaaacctaaccttgcaacgcccgtttgtccttactgtggacgagacgctgttttgcggccagccgagtatgtgtatggtaatgatacgataactgcaggaagcatgctgtatgtatgcagcggatatccggattgcaattcctatgtaggagttcatagaggaacgaaaaagcctatgggctctttggcggataaagaacttcgtaataaaagaatccgcgcgcatcgtgccatgaacagactgattgaaagtgggtacatgtgcaaaaatggagtttatgcctggttatcctgcagcttaaacctgccgcttaaagagacacacatcggatgtttttcagattatatgtgtgagcagaccatcatggagtgcgagcgagtattagaaaattggaaaggaaaaagagctgcataaaagggggcataagcacatgagattagagccatcagataaaccaatgtaccacagaatggatcaaagggatagagcattgattatgatacctgtttttggaatagcagcctcattggggctgttttttcttgcggcccgttttctggctatcatcggtggaccattcatcggacttggtgtgtgtggtatgtttggaagcgcaattcgttattggaagctaaagcagttgattatgccattaagcggatgctacttagaaattcagaccagttgttttgttgcaaggcaaccttggaagaaggaacactacgagcaatgcagaatctattttaaggaagttcaggcgctaataagggaggccaaagcaggtggtttttatctacagattccagaaggcggtgagagtgaaatccgtgggtttggagaaaaacggcggtgtcttttctatgtcagcccatttggttacccggaggataaaatgcaggccatgtaccagaccataaaagaaaggctgcctgaaacggcagaaatatatgaatatgaaacatgaatggataggagttccggaaatgttaatgaaaaagctaatcataaatgcaggtgttatactgggcatactggcagcgggagtttttatggagactcatcaggagggagaaggtgttttaaaactcacaatactgtgcgtgaccggcctgggtctttactttctatacctttgtcaggttattttccagaagaaatatgagacgctggtgggagaagtgaccctgatacaaaactgtaagggcagaaaaagatattgggaaattgaggtggtagatggggaaggcagggtaaagcagcttctgataccggttcagagcggggtgagaaaagggattgtgtaccgatttttcttgaagaatgatattttgctgggggtggaggaaatgtgatgagttatagaaatatatggtaatctgagggtgaagtatgtcaaagatagccgtatcctgcttgactacttcagtagtaatagcagtaagcgtatgtaataaaatcagctgacttgaaaaagtaaattccagtgcatgagtaaattccacgccccttaggaagtggaatttactttttcatttcaggtgtaataaaatcattgtatgatttattgtttatatgccaaatttttggtataattcaaaagataatatgcatatttacatatactcaaaactcagaaaagtggagaaggttaatgggagaagatgaggaaaagatagaaatagagttagaacatgatgatatagatgaaatgtattatcaaggtttgtggggattcagaacagacgaaaagtatcaatttttttatgatgagagtaataattgtagaaagttttggattaagccagatgggggaaagggattatttaatacggatgcctatgaagatttcgttttggcaggtattgtgcatgagaaggaagattatagagttactcttgacgaaataaaggattgtttgggtttacaaaaaaatgttagagaaattaaattcaaaacacagtttgcttctggtgattttctggaatgtatgaaaaagaaaagattaacatctctgttcaagtggattgacttaaatggattatatattcattaccattatgttaataatttgtactatgcggtggtagatataattgactcaatagtggacataaatgaggtagaagagtatggatttcaatattttctgataaagagttcattctataaaatgctgaaagggaaagaacataaattgcagaagctcatgttcagatattgctatcctaatattaggagtgaggatatcaggggattctgcactggattgacagctctttttgaccgaagatatgatttgaagccagaggagaagtttatctctgggttaatacaaagggccagcaataatgaagcattaatatttgtgcaaaataatacagatttcattatgaaagagaactatgtggaattctatataaatccaattcgtacgtttaaaaactcgtatcatacctttgatgaggaattagcaattcaggaagttttgagtcaatatagattaaccagaaacggaaaagaggtaaccaatttcaaatttgttaattctaaaaccgatgtgctggttcagatatcagatgtaatagctggtgtaatggggaaatttttgagttatattaataaaagtgagctaatagggattcggagggatgttaatggacttaataggactcagatagagaatataatgctactcaacggtttgcgtgataaatcaaacaataaaaacgtggggtttcttcaggctgttacggcacaatatgagattgataaaatgaatcattttcttgatttagtaacagccagaaatgaagctacgtgattactgtattgattaacaggcaaaatagaaagattcgttaaatcataattaggaggaagtagatgagcaacatagaaattaagcaattaagcgaaaaacaatatctccaaacgatgagtagcggaatgaagaatatcacgaaagttgcagaatctttagtagatatctggaactatgcggaatatctattgcaaaataatttgctatcagaatatggatttcaaatgagattaatagaagcggtttacgtcaacagtgagaacacatatcaacatatcttgcttagtacttaccagaagaatctttatgttgtgattgttgtagatgtaatcaataaaactattttaggacattatattcttgacttaaatgaaaagtatggcttgaataattaaaaattatattgcaatttgctggggagagaattgattattatattcatatacattaaagaataaaccactcaaggagatgataatatgttgtcacaggaagaaaaaatctatgtcgaacaggcctgcctaaaattaaaggaacgtggttggtttcctggagagaaatttgatctatccactatcacagaacaggaaattgctggttttgagcagcaacatcaagtgaccctgccatctctttacagaacatttttgacctctttcgcactccctcaaaaaagtattcatatatgtgccactatctacgacatgggagattttggccccctatggttaaggtttgactgtccgagaacaatgaaggacatatcagagcagatggaaatcctgcaggagattcgggatttttgtgaattgccggagggttgctttcggaatctgattccgattggagactggggcgcgggctgggggcctttgtgtatagacctttctaagccagaggagatggtggacggggacgatgaagacacatggtctttggtatggtttgaccatgaagattttgattgggatgagcaataccttggtgaagatggtttgcttcacgggcaggcggctttaccaagtctaaaagtattattggattggtatttttatggggaattggaaaacaagtatgaacaggaggaaggtgtaactcctacctatgagtggtatcaggacaccttgaaactgtaaaatttctgcaattaaatctacaatacccctttcattatctactaataatattttattgcttattttatcacttccttgcttttattcttttatctaaaggcttttttgcagttgcatgtataagccggagaatactggcacctggatatgtccggtaacatatctctttttaaattatatttcgagttttggaaatattcaaataaaaatcatttaatattgtacatggacacttgtatacggtttaccctcttttctttactgatccacttcggagctagtggtaaaatcatactctccatattgatgatgaaacacccttgcaatttccatttatgtggataggtacgacattgatgaaagctatgcttagtgaaaaaggctataagtggacttcattagcagtataaaaggctaactatgccttgagaatgtaagaaggttggttttgatcacattttttgatattcctattacagctaacaggcaaatggtgcgtgatgatatttttctttgtgggaaaaagtgaggcgggaaccatctgctgtaatgtgcgctagcagcttgcaggagtgtccatcgcttgtttgctatatgatgccaatagtgaaaggtttccaaaatcccgcatatactgtatcaaatcccctgcatgaggtacaccatggcggactgcccgattaactcagcctcagagactattgctgactttatccaccgtaatggaagccagcagcaatttcctggtaattcggaagatattctctgtatggactttgtaagcactgatttcagcattatatataccccgctagataccgtagaacccatatcactaagtaagtttacctattatagtatccctggactgtacacactgttagatagttccagcatggacgcttccggcattttggcaacccatgcatcacctgcccttagcaatcaagggagaggtgttataatcggcatcatagacacgggaattgactataccaatcctttatttcgtaatcaggatggaactaccagaatcttgagtatttgggatcagagccttccagaagataaaagcctccttcctgccggtgtacccaaccgctataatgccagcggggcaagctatggcacagagtacacgcaggagcagattaacgaggcactggaatctgataatccgtttgccgtggtgccttctaccgataccaacggacatggaacctttttggcgggtatcgctgctggaggaatcctgcctaatcaggattttacaggagctgcaccggaatgtgaactggtaatcgtcaaattaaaaccagccaaacaatatctgcgcgatttctatcttatcagtaatgatgcggatgcttatcaggagaatgatataatgatgggcattaagtacctgcgtgtggaggcatacagccagagaaaacctctggttattttactgggaatcggctccaatctgggcagccatgaaggaacgtctccattgaatgtaatgattcaagatatcagccgatatttaggaatggctacggtaattgctgcaggcaatgaaactggccgggggcatcattacatggggtctgtaccgataggggaagagtccgttgaggtggaaatccgagtagggaatgcggaatcccaacgtggatttgtagtagaactctgggccgacaccgctgatacatattcggttggatttgtctcacccagtggtgaatccataggccgcattcctatcataggcagaaacgaaacctctatcccgttccttttggaacccacggtcattacagttaattaccagctgattgagacaggcgcaggcaaacagcttgtttttatccgttttgaagccccaactaatggaatttggagaatacgcgtgtataatacccagtatcttacagggcaatttaatatgtggcttccggcccataccttgatttctgatgaaaccgtgtttctgactcccagcccatatacgaccataaccctcccgggagattctccctctccaatcacagtaggagcctataatcatttaaataacagcatctacattcattccggccgtggatatacaataggcggattgataaaaccggatttggcagctccaggggttaatgtaagcgggccatcgatagggcgaaggaaccaagactccattcccatgactacccgaaccggaacctcggttgctgctgcccatgttgctggtgcagtcgctaatcttttaagctggggcataatagaaggacataacatagcaatgagcgaagccactgtcaaagcatttttaataagaggagcaaaacggaatccagcactatcatatcccaatagggaatggggatatggggctctgaacttatatgaaacttttttacggttaagagaaataagatgaattatctaaagcatcagattcttatgcatatcacggatacgggggaacttgatggatgttttggctgaggtgctaaaaaatagtcttatcggtggtaagggattaattttgaggtagcggtgtgccgccacaaatacgcttgcaccgtatcggtcaacgccttttccttttatatttcatgtagaggacggttggctcgatatgctttttcagagtagccaatcgctggtcaatggggttcagcttaacccgtatatccatctgcctcccaatcatggacgaaaactttttatcaagtcagaaatggcacggttcttctgaaaatagttgaacaaaccatatgtggagggttgaatattgacacatactatatatagtgatatcataaaagtggtactgatttgtgtgtgtttataaaccacattcaaatgtttgttccggtggtatctataccggaagctaatttttaggcgtaagccttttatatgaacgagccaggcagagtctctgtctgtaaagtaagatatcagaaatctttgcgaatttctgatgtcttattttttaacttccaaaaaggagagtggtaatttaggaaaagataattaaaaatcaagtaaacagagacaagaagtataagacgtctgatatctggaaagagaacaaatatgagatcagagtatttaattaggaggatgtatgagatacgattacaggaagattaaaactgagaaagtagaagtcaaaggtattgtttgcgaattttatgatatgagaatcgacagagcaacagtaccagatggaaaatatctgtatgaggtggcgggcgatgacgacagcggggcagaaccagcaagggtaggaaaaggtgttctggttaatttttatggttccctgatatgaaaccaaccactattgttggaggaaaaagtaatgtggttagaaacaggagattttaaatatgtttaaaatgaaaaccggcagatgcacactactggatagaacttagcggggaagatttctctgcttgtaagtaagacatcagaaattctgaagaagtttttggtgtcttactttttgatcaaaaaggagtgaatggaaaaagaatgagaaagagcaattatgcctgtggagatagcaggttacgaggtcgatgaagcagaaaatccattggctttagacaatgaggagttcactcctaaaaatatatcaatcaaaatgtgaggataattcgtcacgtaagccacgaaaaaaatcatcaaaattcgcattaaaaattatggataatgctactaactcgctaacttttatattcatgcgattggtttctaattttgcataagtgctcttagaaatattaagattcataagatgcaatttggcaacagtttcatcttgtgttaaaccagctaaatgtcgcagaaattgaatgttgtggccaatatccatatctggtcttagtttttgcatatataatccccctggtatgtctgcaagtttcgtaataacgaaatatattcttgattttataaccattaagaattataatgtttcgtgataacgaattttatacaatggggtgaaaaatatttatttatgaaaaaggctgatattgaaagattactgttttactacttatgcggaaatgaaacggcaaaagaaatgtctcaaggaaataatataacgtatgaggagttcgatagaattacctatatactcatagagttgaaattctataatttattaatggaattctgggatgaattttataatcaattccaagaggatattgataagtcgaatacagaggatttttctgatagctttgaacgtgaaataagcagatgtgaaaaatggctatatcaattttgtgaagaagcaccaacacaagagttacaaggaattttaaaagaaatatttgatatatcataatagatatatcccaaaatggagaaagaaaggaattacgccttactttttttatggaatatgaatttacgcattacctatgagattatgaaggagaagatgtctctgcttgtaagtaaggcatcagaaatttgaagaagtttctgatgccttattttttatataaaaaattagacttgacaagcgaccaacggtcgctatataatgaaaacgaaataagaaacgaccgatggtcgttataaggaggtatcataatatgccaaaaggaattatgcttacaccagaacaacaagaagaacgccgagaagaaataatcagtgttgctttgcagctcatagagaaaaatggattccaaaaaacatcaatgagggaaattgcgattttagcaaacatgggaaagtccagtctgtatgattttttcaaaacgaaagacgagattgttgtatatgcagttgagaaagaaatagaagaaacaattaaaaaggttcataggattattgccgatgaatcctcgccggaacagtgtcttagaaaaatcatgctgaatcatcttggagtaccaaagcagtatcgaacggtgctgatgtggttaaatatagaatctgactatttagaagaagattatcgaaagcggctgaaaactgcgcgttacgcatatcaggatattataaaatctgtaattgaaaatggagtggaatcaggcgtcttccgtaagacgaatgccgatcttatgacgggtttgttaattaactccattatatcaatcatttacacatcccgaccatcagccagtccggagaaaatgcttgatgaaacaatggatatatttctacacggaattatgaatgatggagatgaattattatgatttattatactctacccttgttgcataaacaggcaacccttgaaatggtcggcggaaaaggtatgtctttatcaaaacttttgacagcgggtatccctgtgccggagggctttcatgttacgactacttcatacaagatttttgttgaaaagaaccatattcagcctcacattaataagttgctggacggtattgactctaacaataccagccagcttgaaaatgtatctacgcagatagggatgcttttccataatggagaaatgccgcaggaagtatcagatgcaattaaaaccgcatatgccggattgggaaatatagcggtggctgtccgttcctccgcaaccgccgaggatttgcccgatgcttcttttgcaggccagcaggaaacctatcttaacatacaaggtgagaatgaagttcttgacgctgtaaagaggtgctgggcttccctatggacagcccgcgctattgcttaccgcgtgaagaatgatataaagcaggaaattgtcgcacttgctgttgtagtacaaaagcttgcgttttccgatgcgtccggcgttatgtttacgctaaaccctatcaatggcagacgcagcgaaatgattgttaacgccgcgtggggacttggcgaatcggtggtttctagcttagtcacccctgatacaatcgttgtagataaaaatgctgaacgaattgtatcgtatgaagtagcaaacaaagagattatgacagtccgcaactcagatggaacagaagaaatcccaactcctgaacagattaggaaaaaacatgctcttacgcgcaatcaagttatgcgattgacacagcttggaaaaaaaattgagaagtattatgaaatgcctatggatgtagagtgggcactggaaaaagataagttgtatattgttcaggctcgccccattactgtcctaccgccggaatggacgttaccggaaaaggatgttatatatacaagaggcagtctagcggaacacttgccaaatcctgttacgcccttattcgccacacttgggcttgaaatagtcaaccgtgcatcggcgcttttatggatagatatgtttggtaaaagtgcgaaaaagctactgccagaaaacggagcatatacgattattaacggatatgtttatctttccgctaattcaaagcctcttttgattgctgtcaaatccctttccccccgatctttacgccgtgcgctcacgaacagtgttgcacgctgggaaacagcacgaaaagaatttgaggatgtgattaaacaatgggaagaaaagcccatgcatatgctgaatgctcatcaaataatggaggggattcagactgtattttatggagcgtgtatttatttcacgaggattcagcttacattgccagccgcctctatcagcgaaacattatttacaaaattttttcagggagcggcttgtcgcgctggtataacagatacttctgttttcctgcttggatttgatacgattgctctgcaagccgaaaagaacctgtggagtctctcggaatgggtaaagcaaaataatactctcaacctttatctgcaaagtaatccaacagcaaagatagcggaaaattttatgtcctcagttccgcctgacgaagtttcgctggaagtatggatagaatggaaaaatcgaatcaatcagtattttaaagagtttggtcgtaccgcttatgaatttgattttgcatattccacaccgcaggaaacacttacaccaacctttgaatccataaaaacctttgtagaaggcaaagttgaaagtccttttttacgtcaatccaaatttgaaaagcataggaaacaggcagaagaagaaattatacaacatataggtagctcacgcaaaaaactgtttttgaagttgctccattgggcgcaggaaactgctcctatgcgtgaaaatgctatttatttgatgggaatggggcatcctctgattcgccggatgtttcatgaaatttcagtacgccttatacgtggcggagctacttcgcatatagatgatatttattggctcacaaaattggaattggaaaaactcataatacagttagacgaaaatatacctttatccgatagaagaaatttgatacttgagcgaaaagcggaactcaaaaagtatcagggctatgtgccaccagctcagttacctgagaagaaagtaaaaagcatatcacatgcaccccagaaacaaaaagatggaaaaaccgtgttgaggggtataggaaccagttctggtgtcgtgacagctcgtgcttacgtactaaatagtccggcagattttaaaaatttccagccgggaagtgttttggttgccgttactacaactccggcttggacacccttatttgcctctgcaagtggaattgtaacggatattggaggtcctctcagtcattcaagtattgttgcacgggaatgtggtatccctgccgttatggcgacacacacagccacgagaagtattaaaaatggacaaatgataacggtggacggctcggaggggacggtgacgattgatgaataaaaagccgattttcgctttaaagcttgctactttggtgattgcgttaggatatagcttaattcttccggtcatgccattttacatggaaaatctaggtgctggcggtcgtgagcttggatggctcactgccgtatatgctctggcacaaacagtatgcgcacctttttggggtgcactgtccgaccgaattggtagaaaaccgattatcagcattggtattataggatattccatcagtttgttcctgttcggtttggcttcatccttttggacgctatttatagctcgcagtttatcgggtattttgtcatctgctacgtccgttgcatctttggcatatgttggagattccagctcggaggaagaaagaagcaagaatatgagtcaacttggagcttcaatgagcgttggcgtaatgatgggaccattattgggaggcattcttgcaggctattcgcttgcgttcccattttttacaggagccggcatttcatttatagcctttctgctaattctaacacttttgccagagtcaattgagcgttcaggacagacggaaaaaagaaaaccctttgatttttcagacctgaaaagtataatttttggctcagcaggaatggttttgatacttattttcgtcgtgcatttctgtcaaacaggcttgcaaggaattacggggctgtatgtcgtagataagtttggattttccactaagcaagttggtgttatttggatgactctagcaggtattttgattgtagtacaaggctttttgactggtcctttagcaaaaaaaattggtgagaagcgactaatactgataggtatgttttgcaaagccttagtagcgtttgccatggtattgacaactgggtttgttagtgtgttggtggtttttggcttatttgcggtatcttctgctattacagtacccacattaaacgcaactctttcaaaaactgacaatcagcataaaggaacactgatgggatttgccagtaccgccggaaatcttagcaaagttattgctcctttattaactgggtatctgtatgaaagcaatattgaattaccatatataaccacgggagggatagccttaatcggagtggttatctgctatatctggataaaaaatcaaagtcttgctactacttaaacctataatatccttaattcattatgacaaattccaattcaacagttttgatacataaggaggtaacaatatatatttgacagcaaaggaatttgacttactctatttgctcttttgccacaaaggacaggtatttatgaaagaccaactttatgaagatgtttggggcttctacaatgtaccaaagggaagcaacctcacatcattcacaaggaagctaagaaagaagatagagccgtccccagactatccacagtacatattaactgtctggggtgttggctaaaaattcaacaaggtaatgatttgaaaatagaagaatgcaagtagatacgaaattgataaatttgaaattatgggggtacataaccatgaaaaaaatgattgcatattgtggactggattgtgaaaaatgtgatgcatatattgcaacaatcaatgacaaccaagaattacgaaaaaaaactgcgaagctatgggctgaattaaataatgcacctattcttcctgagcatattaactgtcaaggctgtcgtgttgacggaattaaaaccgtattttgtgataatatgtgtggtattcgccagtgtgcattagaaaagggtgttgctacttgtggcgattgtttggatttagagagatgtcccactgttggagaaatcttagagaataatccgtctgctttgaagaatttgaaaggataaatctcaatttgtaaaagtcaataatccaaagataaattttatttgaagggagtatgcaggctatggataactggtttacaatagatagagtaggccgttgtgatttaccaaataacttcaatgtatatgattaagagctttttcaaggaatgccaacaaaaattgtaactgaccatgatgtgatagatattggaggacggcaaattgaagtgttgcatacacttggacattcaccagggcatttgtgcttttgggaaaaagacaaagaatacttatttactggcgatttggtatataaagatatactgtttgtatactatccttctactgaccctgaagtatatcttgcttcattgaactaaccgtgtgattaacatagaccaccagctattgcgtgatacagaggtgggttactatatttccacacctaagacaaaaacgggaagcgtgagcttccattgacagaaagagcatatcaggcacttgaacgaattttaaagaaccgaggaaaagcacaaccgcttgttgttgaaggttacagcaatttcttgttcttgaaccgtgagggattgccaaaggtggcaggaaattatgaaagtatggtgcatgggctgattaagaagtacaacaagatccataaggacaagttgtcaaacatcacgccccattcattcagacatacttactgtacgaacatggcaaataagggaatgaaccctaataccctgcaatacatcatgggacacgcaaacataacggtattatgctcacggtactttccagtctgtaaaggctgaattagaaaggctggcttcttaatatcgaaaatgtatcttacttttatttgagtttcagcggaggaaaggattccacagtactcatggatattgcaaggcagatagacaatcggatacttgccgtatttgttgatacctggctggaatacccccagattcggagtttgtaggaaagtttgataacgtggttatgctgaaaccaacaatggggttaaaggacattatcagacaatacggctggtgctttcccggcaaggatgcagcgcaaaccatctggtatgcgaggcagggaaaggaatgggccctcaacaagttgcatggattggatcggaatggaaaaaaatccgagtatcggcaggggtatacaaaatggctaccactgtatgaatcggatattctgatatcacactactactgtgttaagcagaatgaggagccgattgccctgtatgagaagcagactggacggcatcccattttagcgcttatggcagaggaatctgccaggcgcaaggaagcatatcttcgtactggctgtaatagctttgaaagcgaaaggccacttagtaagccaatgggattttggagagcacaggatgtgctccggtatacagtggaaaaacagttagaaattgcagagccttatggtgaggtggtcgaagtggggcaagttcccggtcagattgggttctttccatcatgtgggccgtttaagtgcacaggagaacaaagaaccggctgtctgttctgtccggtgggctgtcatctgacaagctttgaaaaattcgtaaggctgaaagcatataatcccaagctttatgatttctgtatggaggaattgggagagaaaaagctgcttagctggatagagaaaaactataggagaggatataaacagattgcatgatgctacgatttagcattcacattgaattggataactatatatagagttgggatgttgacaaacactatatatagtgataaaacaaacatgatattgatttgtgccgcttttttactaagcgcattggaatgtttgttccgggcaaccggaagctaagtttttcaggcatgagcctaacataagaaagccaggcagagaagcaatctctgtttgtaagtaagacatcagaaatttgaagaagtttctggtgtcttatttttttgcgaaaaaaagaaaaggagaaagaaaaaatgaacatggaaacccgtaagacaagttttgaagagaagttaaaggagaacttgggtgcggaatataaagtgacatttccgcagcgaatggaaaaacaggacgaggaatttctcagggttggagtccaaaaatccggtgaatcagctggaatttggatatacctagtgtggcactttcagagaccatcggtgcttcggaagaacagaatgaagtggaagaggaaattgaaggctgggacggggagctggaaagagaaccggaaattcagtgattgaaatgcaccggatgacaacagttcccctgcgattggaaaaagaatataaaatgattgctccagaaataaacagaatctcaaaacggctggaagcatcgcttgaagaggtgctggagcggttggagggaggtacgcaatcaggtctttacatggggaaacgtttaagccgtggaaatctgtaccggctggatgataagatttttgaaaaaacaataaaaccggaagaaggattttcaatcgcatttgcggttctgcttgacctttcaggttccatgtcatccggtggcaggattgagtctgcacaaaaagcgggtcttgtcatgtatacgttttgccggaatctgggaataccggttatgctatatggccatacaacccatgatacgggatatacggaagtggtagacatttactcttttgcagattttgattctgtagacaatcaggattatttaagaatcatgagtgttagtacctatgattgtaatagagatggagtagcacttagatttgtaggacaaaaactgctaaaccggccagaggatataaaaatattgttaatgatttcagatggacagccttatgcccaaggatataaaggcgaaattgcaaaagcagatttgcaagaagcccaatatagcctggaaaaaagaggagttaagttgttttccgcggcaatcggtgatgaccgtgagatgattgaggaaatatacaaagatggatttctgaatattgcagatttcaatacaatgccagtcaaactggcaggtctcatcgcccggttcatcaggtagaggaggagacatatggcagaaagggaagaacgggactggtctaacgtagtatccggtcagattgcagtgtataaaacagataatgcactgttagaactcatggataatttaaaaccagcgtcatatttatttccggctcatatccatgcgtccggagacgtgtcagaagttggggaaaggtccttaatccgtcttaatatgctggattacagcaaaggaacaggggataatacagtgagtgtctatgccaatatcagcccggaagaagctaaatacatatactcggcgctctttaatcatctgtgggaatttgattatccccaggaaaagatttttggtaatccagataaggagggttacagtattgtcacaaaacttaatattgtcaggtatgatactgattcccaggggaataaacgtaattatccatggtttgtagaaatacaaaacggacgcggcattgcaatgaaaaattccaatggcggccggtattgtaaaaagaacagttatatctgtgacaaaaaagccagtctgtacattaatgataaagatttgtttatcctattttgcaagacagacgcttatatacgcgcgtttgagtcagagtatgcatttcgggaaaacaggattggaaactttaccagcttgtatggtcttttaaagaatgagatacagggagcagccgacaaactgctcacttgtatccatagggaagatgaggaacctatgaaaacggcaggatgatttagttctaaaggccctgtaaaagttgtttgcttgaataagaagggcagatatgatatattagatttgtaaaagcataaattgtctggaacagcctgcaaataaaaagtcaatagtataatgaaaagtttttaagagttattgttgatgaaatttcaagtacaacaaatagaccaccgttatccgctggtctgaaaggttgtggcattctttattctggaagagacataagatattcttttactcttccgtaatagatacgcagaaacttattagcacctgcggtcatgtagacatagtaaggttttccctgagcccgtttcttgtcaataaacgcatatacagggtcatcctgcggctttgttttgacgagacagtccatgacctggaacaaagtctttctaagggaagatgagcctcgcttggaaattggaacgcttttctgttcataagttcctgattcatttacgcctggatccacaccggcaaatgcggtgatagctcctttatgagtgaagcgtgtaacatctccgatttcagccataagctgagggccaagtgatgggccaacgcctttcatttccatgacaacgggatattcaggcagcttagaggcagtttcattcatcagggtacggagttcttccacggtcttggaagcagtgtttaattgttctatggcctgtttcacaatcagcttggttaaatcatctttcggaagtacaggaacaagctctttggcagctccatagatttcttcagccttgtctttgctgaagttgtacatcctgcgtttgcaccatttctgataatggccgacaaatgcgtttaatgacagtttacggacacagtccacatgccagtatgtagtggcaaaatcaacccacttctggctgccgtcctcacgggcagggctatcaaagaaagtatttacacctgggtaagtctgatcgaggataccgatgaggttattcttcatagctgttttgtgtttcatatagaacccaaactgacggttcatagtctttaattgattgcgtagttcgtccataagactatactgtttcaaatcaatccagttgtcaagtgtataacgggctatttttacagcatcagctttatccgattttactttacggagagaattatttccgaaatctttaatgagcttaggatttacagcagtcacaaaaaggccagcgagagaaagttgacgggcaagtggttcgtaataacggccagtatgctccataacgatgcgggagttaccttcgatagatttaatccgttcaatcagagattggatgttagaagatgtatgtttgatttcaaacggtgaagaaacaatctcgccataagggcgaagaatagcaaccatgctcttgcctttggaaacatcaatacctactgcgttcatattcataaacttgtcactccttaagattactgcaatggataagtaccagtttaactcattgcctattccatctactgtggtgtgacacgaacgtaccggaggcagttcaacctgcataaaacgaacgctgcgaatgaggagctggttatcagtctgtttttacggacgcaaagtccaggaaaggaagccgatataccgattgctccatcattataacagcttaagcaacaagatggataagtccttactggctgtaaggaatattaaccataaatatattgtagtagaaaggagggcttctatgtgccagatctcaatccgcataccggatgcagttatgtatgatacacatatgagtgaggaggaggccgctgcatttgccagatgtatggtagcagtaggatattatacgcagaataatgtgtccataggatactgtgcccagatagccggtatgacagaagaagaatttattaaatatctgggaaagcggaaggtcagtattttccagtttgacaataaagcagagtttttggaggaactggagaatgcgtagagtgattgtaaattccacccccatcattgtactttgtaatattggattattggatatactgaaggcgctctatgcagagatttatatcccggaggctgtataccgtgaggtgacagagaaagacgattcggcatgtcaggtattaaagactgcattgaattggatacatgtggaaagaatcgcaaaccagtcagataaaaagatgtataaggcgaagcttcacgatggagaagtggaagtcatgattctggcccaggaggggacagcggacgatttagtcgtgattgatgacaatgctgctaaaaaaacagcaaaatatctgggtctaaaagttaccggaacaatcggagtccttttgaaagccaagagagaggggattattccggagattgcttccgttctcgaaaaaatgaaaaagaacggattttatatcagcgaaaacctggaacagctggtactggaacaggcaggagaacaacacaatatatagcgtaatgaagttgacaaaaactatatatagtggtaaaatgagtgagaaagctgatttatgtaatccaaggattacaaatagtttttgttccggcattaaaaactggaagcaggatttttaagtaacagaataagagcagctattgtgctgcgggaatgaagagacatcaaaatgaattgttttggtgtctctttttttgtttgcagaaaggaggaagaagccagaaggcggaaaggagggagcggatgagagattcttacaatccggagggatatcattgccttatcattgcaatcttaatgggagtcaatgcaagggaggcccggtttctgtatgaacatggcctgaataatccgatttcccaaaaaattttaaaaaagaagtatcccaaaattgtgcgggtgtcaacaagaaaggagagaaaagaagttatacagcaactgagaagcgagggttacagtatagaggctatcgcagatattttaaactgtgaccattccactgtgaaacgaaattctaaattgaaaaggagattcacatcatgatgacattagaaaaatttgccgaagctgtcagctctgaagtagccaaaagattaggggccggtttccatgtgcatgttctgaaaccggttatcaacaatggcatagtccagacacagttgtgcattgaaaaagaggggcagcagtttcgcccctctaagtccattaatgcagaggaagttccggcagatgaacggttatccaatcatgcatatagatattgttccgctgaggataaggttatatgcatttaaggtgactttcattaggataggagaggtttatgcatatacataaatttgcagatatcgcctcgtttgcagagattggggttggagggaatcttccggcgacagaagagtaccgggaattcatcaaaaagctccacccaacacagttcctgacaggacggctgacagctccgttatatgaagtagagtattcctatgtaactgtgcggggaaattaccgaaaggcttataaatatatcctgctgcgtttggagcatgatgatctggacctggagattgaaatgatattctcagactgggtagaggaattaaaccgtaaatgtccataccggcgtattttaaatgcacaaattcttaaaataacgcccatagcgtatgcaacaatcccatttgaaatctaaaaaggttccattccctcatttcccggagaaaactcctggttgccgcacgtaagcacccaatacggccgtaatgtacgtataacgaaagaaggaggaccaaatgaaaaaacaatcgtgtaggaactgctacaatattgatctgaataaaaaagaggaaacagaaggaaggctgagtggacgctaccgttatggctgcaccgtgcaaagaagtgggtttatatgccgctttattatcagcgatgagaaactggaagcattggtatgcccaaactggaaaggagggaagatggaggaggcagactataaaaggttggcggacgaatttgggaaaaggcttcaaactctgtatgaccggtggaatatgtggaaaataaggggctgcccggaggcggatgtgcctgacggggaatatttaaatcgacttcgcagtggaatagaagcaatgatgaggcagattgagaataccttcgttgaggcggattacccagaatgttattatgctccgcttcctcccgttatggatgtggattacatggcgaattgccagcaaattaaagaatccgcgattcgtgcgcttgaagaataccgaaataataaggattatttatggttagcagaccatatccaatatttggataattaggacaaagaaaacagtgaggcttaccgtctcttgtgtcatgtacaaagtttggaagaagcgatttgcgaagatgcctacttgcagatgaagagagtgagcttccaggaaagcctgtatgatgatctggctaactgtaaaaggcgtattttgaaaagaaagcgccggccgtcaaataagaaatcgaaaaaaaatagcccgcagattgttggtcagttaagaatcggtgatttgaaggcttcataaggaggaaaagaatggaccatcttatgttagtaaaaaatctgttcaatgatatgtttgtgtttcttaatggtactcaaccgctgcctttagaatcgctggatgatgtctaccagggggaaccactatttctggcgctgattggaggattggaccaagcacttttggttgattataatagcgcaatgcaggaaagctatggattctataagaagtattgcggcagagaacttactgaagaggaatgggaacaagtggtagaagaaatccagatgttcattgataaatggaacaatagctggtgtaagggaatgattttggcgttattggcgttgatggaacaggaagaggacgaacggaaaggagaaggaaagatggagctggcagaaagttccggagatgaagagctggatagcatggataatgctgcataaagtcagtatagccggggaatggtgaattctccggctggatttaaaggagtatgacaatggtagaaaaattatataaaaaggttaagaatattcaagattttaacgagacagccagtaagttgcgtcaaatgggactaaaggatgaacttaaaaatcttgccgggaaatataaggttcctgaagtagatttgaaagagttcctctctggaaagcggtatttcctgatagacggaggagagacgcagaaagattatatgtcagcccggagtaagctgttggatgaaatgtttaatctgaataatcctcactttacggatgttatcggcaactatctcataaagtgctgtgataaaagtgattttgctgacctggtgctccagaaacataagacactgcagcggtgtgttgagtcaatcatgagtcggcgtatgaaatggtaagcgatgaggtgaaaaaaagcggccgatatgcgaacatggctgttttggaagacacagtttttgaatgggtacgggattattatttaactgatgaccgcgaaaaggaggccgagagaagaacggaagcagaagaggccttccacaaacgattgtcggtgcagatgaatacgccgaagggaaataaaaacaaaaccactaagaaacgcaacgcttccaagaaaaataaaacaggtggaacaaacagcaatgcatctgagagggaaggaaaatattcttcagccaagactgaggcagctgaccagaataaagaccagattgagggtcaggtttctctgtttgagaacggcctggctgaataaggaggaaatgaccatgttgattgcatttaagggctttgataaggatttaacttgtacaaaccgcggtaatacataccaatatcgattaggcatgtggaatgaggaggataaagcaaattgcggaataaatggaatgcattgtgctgaaaacccattggactgcttatcctactatccggactgggacagggcagtgtattacatggttgtcgctgatggtgatattgacgaggatgcatatgacagcaaaattagctgcacccggttgaggcttataaagaaactggacaaaggagaatttgtggctcatagcttaaaatatcttcttgatcatccatttagaaaaaacaatcaccttgtgtgtctgaatcaaggcgtggcaaaaaacggtattgtgattgtcagaggaaagaaccctattgccaaaggcacaaaaggagatatcctgggctttgcaaaagaagtgagaagccagtccgagattacagagataggaatacatgttgtggatggaaaagagattcttccagatacttggtatagcatcaatggaaaaataagaaaggcaggataagagttatgaagaaaacaagactgaaaaagctgggtcatctgtatgcaacagatgaaatgctttgtatggcggaacaggatataccggagaataaaaagattgggtggcaaagagttgagcctgtcttccagcgaaaggtatatctgcagagtcaaatttgtgacggtattttggtggttgctatctatttggcgagggatttacggctgggaagtataaaaccgttatatgaaaattttattgataaaagtaaaagagaatatcttacttgggatacattaaaggagaaatggcgaaccgcgtgtgtggaggcccttggatttccgcattactacagttattcatgtgcttacatgacaccagaagataagattagattgactgagtatctgggagttacccaggaaggtatggaaggtatctgccagtaccagcagtccctcctgtaggagcgtctggagaatagatataaaaaagagacatctctatgggaggcggcgatgaagttggttcccaatgttccaaaagattggcttcgctgggtaaatagacatggattgaaggagaattttatattttatgattattcaaaaaatgtgaaagaggggttttgtacctggtgcgagaaaacagtaccagtaaagaaagccagacataatacatatggtacctgcacttgctgcgggcatcgtatccagtataaagccaagggaaaagcagggagactttgtacaaaggaagaacaggtttatttgccgcaaaagtacggtgatggtcttataatccggcagtttacagcacagcggttctatcaaaaaggggagtatgaaacaccagaaataatgtgtaatgaaaccggaagggttatttatgataaggatttaatgggtacacaatattattatggcaagtataaacaaagaggataccgctggattaaaggctatcccaattactcgtttttttatggatactacgattataaactgaaccatgctggggccgtgtataaacgtacagtaccagcactgtcccgccatatattaagcaggactggtctgccgcagttgatatcttccggatacaaaataagtccgaatgattatctgagcagtctggccgcggccccgtatctggaacgctttatcaaggcaggactaaaacaccttactctggatgcacttaaggggcggattaaggtgtcagaatcccatagtctggcaaagtcgctaggaatagacggaaaccgtttgggacggttacggaataatgatgggggcgaattgtttcttatatggatgcagtatgaaaagaaaaaacgcaaaaatatcgtggattcagtaatttgctattttgaagaacagaatatccgaccggagaatataaaattcatccaggatagaatgagtgaattaagaatatgcaattatctgaaacgtcagtatgcgttaaccaaccgacctcccctggaacttctatctacctggcaggattatctcaatatgtcaaaacggctgaaacgtgatatcacattggaaatattctataagcccaaaaatctggttgaaagtcatgatgaagttctccagttgtgtgaagataaaaacataacgcttcaggcagttgatatcgcaaaagtatatccggacgtggatgcaatctgcgagtccatcaaagaaaagtatgagtatagagatcagaaatatgttcttcttattccaaatcggattgaggatattatacaggagggcagggcactcaggcattgtatacgattcagcgatgactattatgaacggatacagagaagggaaagctatattgcatttttgaggaaagcagatcagccagagaagtcattctatacattggaatttgaaccggacgggactgtccgtcaaatgcgtacaagcggtgaccgacaaaatgtggatttcaaccaggctgtcagctttataaaaaaatggcagaaggcaatccagccacgattaacagaggaggattaccggttggccaaagtaagcgcaagtctccgtgtagaagaatttaaagaactgcggaagaaaaatgcgaaagtatggcatggtcatcttgcgggcatgcctttagctgatgttctggaagctgatttgatggaagtttctttgtgtatagaggatgcaagggtaacggaagcagacggtcagaatagcgaacttgtggccgcataaaatcaaggagggatacggcaaatgaaacagaagctttactatattaagaatgaaacagcggaaaaagcgatttataagaatttagagaagcagagattttcagtgatagaaaaagacagcggacctccaatggtactatcgttttccgatcataaaaatgtgactgatgaatatgagtatgtttatattccacgcgcgatgtctaaaaaagaggttgaaggtcgttttgaagtggagaagcaatgccctatgtgtggaaccattacaagtatttatcttacagatgaggacatggataaatacagctggtacagcaactcgcgtttcaatcgtaggggaagcggcctgccggctccgtatatccaaaacttatttccggaccggacagaagaagaacgggaattaatgatgtcagggtactgctattggtgccaggaagtgatttttggagaggatgagtttcttctaataacagaagcagaattttcgatggagccagaccacctcattgcatataaccgtgcagaccatgatggatatcggtggtggaataggtggtttccacaaaagggtacggatggaaaccagtacatggtgcaggaaatggaaaaattctctgcgtatattttggaggaacagcttggcaagggcatttccgacattccgaaacttggagcgtattatggagcagagccatctgaagaccaggaatatcacttgtactgcgagggaacatattgtgattttcatgtgaagcttataaataggaagagaagctacaatgtgtacatatatgtttacgaaacagaagagtaaataaaaaataggcaggaagccgccgggacatatggtatctggcggcttccgtaccatttcttataagaagaggatatgggatgagagactatattaacagaaatatcaggatagatggaagattgattccctatccggtgtatacatcttgggaatattttgagttgcatgatgggattgaagatgtggaagattttgtagattcaaatcctgcgatagaagaattagtgactcagattttagcgttaaaacagagttgttttcttttgcgtcatacaacacatagctgccaaagcttaagcgacagtttgttctacctaaaacttaaacttattaaagagctcaaagagaaatatcattataattttgatgatgcatggatggaaaatctcataggcaggatttgataccataatgacatgtttcgtaattattatacaaatatgaaaaaaggtagttacccatagtggcatgaaatggaggcttatatgaaatatgaagaatttattgcggcgctttgccagaaaatacgcgaagtaacaaaaggatggagtggaacgagtatagaatttaggacaacaccacagaacaatgggagaaccttggatttactggtggtgagcaagcaagggaaaaaaatgaatggaacttacgaattaagtttccatacacaggaattatatgaagcacttgcatttgacaaaatggatttgaaacatattttgagaatagtggaaagtaaactgagacaggctggggaagttggaaaaatcagcccgctggaagtcgctgatgattatgagcagatacgaagtcacctgattattcgaccgattaattatgtaaaacatatggaaacgttaaaagacggaatgtacgatttaattggtgacattgctttggctgtctatattcatattggctttgttcatggaacctatgtaagcagtgctgtgagttccgagtacctggagatatggaataaaggaaaagaagaggtaataaaagaggcatttacgaatacatataatttatttccgccaattatgttgacaggtcctgaggcatattctgtcatggataccgatatatttcaaaaggatgctggatatgatatggttggggttacaaatgaagtcatattcaatggagcagtttcaattttccttcctggagtagcaaaaaaattaagtgatatcttaggagaagatttatatattgtattccttaactatgattatgcagttattcatcctgtcagcattatacggccagaggagattcgcagtttaatagctagcgtcaattctgatagtccggatgaagaaggatttttgtcggatatgatattcacatacagacgcgattctgataaaatggaagtagtgaaagaagtttatagttaggtaaagttttctgtatgatatagcagtgtatgtatgagagtatatacactgctgtatttttatttcggtatattgtataatggggttagatgattagatggctgaaattgtaatttaaaaggtggtttaaaatggacattaaggaactatacaacatatatcaaggaaatccggagaaatttaaaaagattgtattgtatcgcaaccttcttggctcgccaatttcatataattacaaagattcagatttagaatctttagtacagatgataatgtcaatggatgaaaaatatgaaacagactttggatttatgatgatggaactggggttggcttatgaggctatttatagtaacatgaaaaataataatgctgccagagaaaagacggaatttatgaattatccattggattatcaattgagggcattaatttcgttttttgaggatcagcataaacttggtattgagttgaataacatagatggtaaaaagccaatcacagggataaagcatttggttgcaaatgtagaatctgaaatctatcctggtatgagatattcaacatcacagaatagcgaaaatctaatagagctgatagattattcaattccttatttatattattatgacagtaattttgaaaaaccttgcgataatctaacatatgagcaatgtttgcaatgtccggatattatgaagttcgttcatcattcaaatttttgtgaattaataaacggattatggtccctttatatatataaggattactcggttaaacttggaaaaacggatacagatgatgatattacagtttttgtgcccaattccaatgaagcgagcctgattgattttgttgcaggaatacgcagagaggccagaagatttcaaaatagtattgatttattgatatcaaatcaaaatagaataattaatgggaataagtttataatacgccttgccaagaaaataaagttggatttgtggaagagcatttttgaactggaattggaggtctacttgcgttgtaatttatctgctaactgcacaatgaaaattataaagcagacggatatttttccagcctatttaaggcaaacgttaccatatggtgaattgaatgacttccttgaagtgcatgaatttttggtgacaatgagcgaaatttattcaaatatcttaaatcataattgggaagagattgaacatgatcggtttaattatctatgtccagtagttgatattgatttgctaattaaaagtttttcacgattatatggcaagagtttaaatacagcagctaagctggtggagtggtttatatattatccgcaacgcgggaaagagggcgatttattctcaaaaccgttggttcaaataagtggtaaaagggttttatttgcccctaatttgattcggcaaattaatatcacccgaatgcttgagcagattatgctggattataaaataaagcgggcggcaattggagatgagtatgaatcctatttaagaaataaattgtctcagtcttccttatggaatgtctatgcagataaaatagaatttaaatcctctataggaaatacagattttgatgttatagctttatttgataatcatgttgtgataattgaaataaagcatctggtgacaccttacgatcccaaacgttactatgaagaccgccaagagataaagaaggccataaaacagcttaaactaaggaagcaagttttattaggggattgggccttgattagagatataaccaatggatttcttcctcctgaacattatccggaagaacggattattcaattggtctgcacgaatatagatagctttacatcgctggaaattgatggcataagaattgttgatgagtccgttctaatcaggtttttttctgacaatggccagtatgtaaagatatggagtgggtcgaagatttataaaaaggaaaaaatatgggaaaatagccaaccaaccatcgatgattttaagagatatattgcttctccgactgcggtgaaatggtatagggaggttgtaaaaagaaaaaatataacaataccaagatatggagaaggagaatatcttggcacggtaaattatattttagatgaagatatagtgaaatttgatagacagatataaagcccagcctgtgttttgcagatgatagcgctgggggatataagcaccagaatctgttttcatgagggggtgcaggaagcatattgcttctggccacactaatcagaagtgcccctattgtaaaacgccgccttgttttttgggatggcgttgttggtaaggttggcaactctgtacctagtagtgatttttattcccagatcaaactatacttttgactatctctttataagttcttatatgccggtatagcctgtatttacaggcttcccggcgtttttcgtatcggaagatattcttaaatcttctcatatcccctcatgtttcagtgttcaaaggtagtagaaagagtagtaaaacctctatttactactgcgcaatcaaccgttccattttcgctaatgcactgtcagaagtggcatgagcataatagtttaacgtcatgttgatgttggaatgtcccatgatatactgtaatgcttcctcatggcacttgtactataattaataaatttagttttaattatttacaacttgagagttttactattcgataaatctaaagtaacggtcgctgtttcaaagtgtatttcatatactatcagtgatttccaaccatattctattgtttctcgataatcaggtatcttctcgcaaaaacaatctgccaaatcaaaaatagtttttttactcttgatagcagttcctctcgcttttatatgctcgttttctttttttggaattgttgtaaaggcaacattctgattttgtttcatttcttttactttgacgttatttttaaatgttgcaaagtatacaatattattttcgggattgaaataataattgacaactctaacatttggaatgccgtctgttccgatagttgccaacgcaaggtcagtctgttctgccatcattttttgaaattcatttagtgtatccatagaaatcctccttttattattgatacatgattagtataatataaaaagatatcagaatatgacaccatttaacgaaataagaaggtttaaacaaatgcgtaaatcaacacgattgaatgacatgatgatttttttaaatgataaaagtttttttaacttgaaagatattatgcaagagtacggaatatctaaaagtacagcaattcgagatatacaatctttagaagaaatcggtatgcccatattttcggaaactggaagaaatggacgttatgggattttgaaaaacagacttctttcaccaattatttttactgttgatgaaatgtatgctttgtattttgctatgctaactttaaacgcctatgaatcgactccttttcatttaagtattgaaaagttaaagagaaagtttgaaacttgcttgtctgatgaacttattaatactattaataagatggaacatacattaagccttgaggggactaagcattataatagcagccctttactaaaagatattttagaaatggcagtaaaagatacggtgtgctgtatctcttataaaaaaggcgaattcgtatcagaagtacaagtgcagttttttaatatatcttcatcttttggacaatggtatgttacaggttttaatcatgacaggcaaagagttcaagttttccgttgtgataaaattattgatatttcagaaagtgagtgctatataccgaagccaaggcaagaacttctaaatcgttcgacaaacatatttaagtctgaaaatgctacagattttgaagttcaaatattagataaaggagtggatttattttataaagaaaattatccctcaatggaattagtcaaatatgatggacaatttaaaataaaaggattttacaacgtaggggaagaaagatttattgctgattatttcctttcatatggaaaattgattaagtctatctatccagagcatttaaaaaaacttgtatcgaaacgagcaaaagaattgtaccaatattacgataatctataaaaataaggcatataattttatgtgtttgtatgcttatgaatttattttacaatcttccagttgctatccttatgtagtacaagttcaaactgtgatacctacgttgtctttgtctgattatcaatgaatttcacggcaactttgactttcacattattctcatggcaataaaatccccctttattcctcttgattatctcaaaacagtaaagaaaaagtcctgtcaagagccttgccaccgtaggtggtgcttgcactcttgatcggactttttgtttgctgtatcttctgtgagaggataaaggctattcatcttcaccatcaaaattcatatttacaataaccttgcctttgccgaattgaacatacgggttcatgtggacaaaatgattatgtgaggaagaacccacagtatatcatggggcattcaaatatcagtatcactatgaactggtatgctcatgcgtccatagatacggcaaaatcagaggttcagcgtctaatcgcatagaagtatttaccacgattttaaccacgtttgaaaggaaaaatataagaagttagaccttgatatgcgaggtttaccacaaaagaaaaatgcccgaatagctgataaaatggagctattcggacatttaagaagaaatgaaaagataaggaaagagacatatacaatttaaaataatcaatttatttctataagatttctaaataatcccattctaatcctatttatattatataaggtttattttttgtacattgaaaatagcataggttcagttgtcctataacaaaaactgaaattgagcatacgagagatacgccatagcagaaatgctgcgaaatatatcaaatcaaaataagcccgggcaggggtttgatggcttgtgacggccgcataagctgtgcgaggatgatatcagttggaaacttgtggggactgccgctcacctaatgaggggaggctgcgttagtatggaaacatctggcgtggtttaagctgttttgcaaacagataggacaactccagatgccgggggacgagtaaatacggcatgaaaatttgctttggagaaagcacaaccaccttaatgaaatgttataagaagtaaaaaaattgtgaaatgctcttgaggaaacaaaagccaattttttacaatgattgtagagaaacagactgttttaaaaaagagcggttttgtgaaatcaatatagtattagcgattagtctaagattgaaccacgttaggtggcatcaatcatgctcatggctagttgcctttgtaaagggggtgacagcgatagaagttttacagaaagataaaaaagtatataacgcagaggaaatccaggagattttagggattgggaggagcaaaacatatacctttttggacgaggcgtataggaatcaaaagccgttccgggtccttaaagttggaaagcttttcagggttcccaaacaatcttttgatgactggctagacggaattagttaaggcgggtgagatagttgaaaagaaaaccacagaatagtgcagctttttttgaaaataatccatggtatcaccgtaccaagatacttcaggacgatggttcgataaagtacagcaaaaagggcgggtttgctaccagtgaagaggctgataagagctataggcgacacgaagatgagtttaaaaaggcgtatcgggcctatcatctggcacatcaaatcaatacggaagtcacgcttaaggattatttgatttattggtttgaggagatattctctcaaagaattgaaacaacaaccagaatggtaggcgcgtatgcggtttatgacttaattttgccgaatattgagtacgacatcaaggtccggtttgccaatgcagagtatcttgatgcattgttggagcgggtagcaaaggtcagtgcctctggaggaaataaagggcgggagattctaaatatggcaatgaaagaggcagtaatcggtgggtatattaaaaccaatccggttactggcacaaagccgtataagagacaaaagccaaagataacaattctgagtaaagaaaaaatcaaggtcctgctgaaagcgtcttccgaaaataactggtatttggaaatattgttagggctattctgtggcttacgaaaaggcgagattcttggacttaaattcagtgatttggatatggagaaaaggaccgtaactatcagaaggcagattgcttcagatccacttatcaaaaaagggagtggaagtaaaatagacaattatgggctgattgaacgagacccaaaaacaccaaacagtttccgggttttgcgggttccagccataatcatagaagaactggaaaaacggagacgacttgtggagtccaataaggtagtgtatgccggtcaatatgatgacaaggattatatcagctgtcagaaaaatggaaaactacatagtttgtcagctttaaatagcgctttaactggaatttgtagcaagaatggccttccgcatatcacggtacatggattaaggcatatgtatgcaacaattctgattgagatgggggttccactgattaagatatctgcattacttggacggctctgtccacacaacgtttgaatattattgtgatgtaatggatgaagacgagaatatattggcatttatgaatcaagcattcgttcctgtggaaaggagagcagtatgataattgatttgagccttcagcagtatgtggattgggaagtaaagccagtgattcctataaagggaaaattcggataccgtgttgtgttaaaatacatagatggtactgaaagaactcagcaaaagtcggggtttaggacagaaaaagagtctaatgctgccagggataacacaataggcaaattacatgctggaacttatattgtatatgagaatgttaaagtaagtgactttctagagttttggctaaaggaggatatatgcaagagggtaagaagcgaagaaacctatgctgcttattccaatatcgtgtataaccacattattccaatccttggaaagaaaaagatgtcgtccgttaaccgtggagatgttcaaaagctgtataacgaccgtgcagaatattctgtatcggtctcaaggctggttaaaacggtgatgaatgtctctatgaactatgctgtagcgaaaaaaatcattgcggagaatccggcagttggtatcaatcttcctaaaaaggtaaaaaagaaggaataccatgcccgcagtattgacacacagaaaaccctgacaatggatcagattctgattctattggaggccagcagggacacgccgatacatatgcaaatcctgcttaatgtattaatgggacttcgcagaagggaaatcaatggtgtgaaatattcggatattgactatattaaccgaacactaaagcttcgccggcagctggggaagaaaatcaacacaaaaaaagaagactttccacctaaaacctttacgaaacaggaacttggattgaagaccccatcgagttaccgagacattccgataccagattatgtgtttgaggcgattctgcaacagagggaggtgtatgagagaaataagagtcgcaggagaagccagtttcaggattcaggatatgtttgctgctccaactacgggaaaccgcgaagcaaggatttccattggaaatattataaaaaactgttagcggataacaacctgccggatataaagtggcatcatttacgcagtaccttctgcacactgcttttgaaaaataattttaatcccaaagcggtatccaaattaatgggacatgcaacggagctaatcaccttagatgtatatggtgataaccgggaaattattgctgactgtgtagatgaaattcagccgttcatagatgaggtgcttccgataaaggaggtagacaagcagcttgaggaagaactgttggaaatcgaagttccggcagaagattatttttaaaaattaagggcagtagtagtttcaatcaaatatcaatttgtttctcaaaatgaaacaaggcgcaggaaagaacaaatgttcctacttgcgcctatactttttccttccgctatgttataattttggtgacatttggtattactaatttcattgagtttatatagtgttgcggagttaagaaaatagcattttggtgaccttcattcgtaaaatggcaaaagttcgtctattaggcaactcaaaacggtcttcttttacgaatttctgcctaataggcgaactttttaagtggtcaccaaggaaggaaaaagcgaaaatggagttcaaattacactcagaataccagcccaccggcgaccagccgcaggcgattgaagcccttgtaaaaggcttccaggaaggcaaccaattccagactttactaggggttacgggctctggcaagaccttcaccatggcaaatgtaatccagcaaatccagaagccgaccctcatcatagcgcacaacaaaacccttgccgcacagctctacagcgagttcaaggaatatttcccggagaacgcggtggagtacttcgtctcctactacgactactaccagccggaagcctacgtcccttcaacggacacatacattgaaaaggactctgccatcaatgacgagatagacaagctgcgccactccgccacggctgcgttgtctgagcgagaggatgtaatcattgtggcctccgtgtcgtgtatttatggtttgggaagtcccatcgattataaggagatggtaatttccctgcggcctgggatggaaaaagacagggacgaggtaattcacaagcttatcgacatccagtatacacgaaatgatatggattttaagcgaggcagtttccgcgtaagaggtgatgtgctggagatttatccggcttactcgggcggagacgcttaccgggtggagttcttcggggacgaggtggagcggattacggagatcgattcgcttaccggcgaagggaagacggagctgggacacattgcgatcttcccggcttcccattacgtggtttcgaaggaaaagttggagcttgcgactcagacgatactcgcagagcttaaggaacaggtggcttattttaagagcgaggataagctgctggaagcgcagagaatttccgagcggacgaactttgatgtggagatgatgcgggaaaccgggttctgttccggtatagagaactactccaggcatttaaccgcatccagggcgggagagccgccctgcacgctgatcgactattttcccgatgatttcctgattatcgtggatgagtcccatatcaccctgcctcaggtccgcggtatgttcgcgggagaccggtccaggaagacgaccctggtcaactatggattccgtctgccttccgctctggacaacagaccgctgaattttgaggaatttgagtcgaagatcgaccagatgatgtttgtgtcggccacgccttctgtctatgaggcgaaccatgagatgatgcgggtggagcagattatccggcctacgggacttttggatccggagatcgaggtgcgtccggtggaaggccagatcgatgatctcgtctcggaggtcaacaaggaggtcgcgaataagcacaagattctgatcacaacgctgacaaaacgtatggccgaggacctgacggattacatgagggagatcggaatccgggtgaagtatcttcactccgatatcgatacgctggagcgttcggagattatccgtgatatgcgtctcgatgtattcgatgtactcgtcggaatcaacctgctgcgtgagggccttgacattccggagattacgctggtagcgattctcgatgcggataaagagggcttcctccgttcggagacgtctctgatccagacggttgggcgtgcggcgcgtaactctgagggccacgtaatcatgtatgcggattctatcacggattccatgcgggtggcgatcgaagaaacgaaccgaaggcgcgcgattcagcagcagtacaacgaagaacacggcatcacgccgacgaccatcaagaagtcagtccgtgatttaatcgctatctcgaaggcggcgattgaggacaagaagtcctttgaaaaggatccggaatccatggaccaaaaggaactggagaaactggcgaaggagctgacgaagaagatgcatcaggcggcagcagagctgaacttcgaggaggccgcaaggctgcgtgaccgtatggtggaagtgaaaaagatgctccaggaactggacgagtaaataaaaccagaaaactatccgtaaatcatagaaagtcagtagcatttgatattgacaataattctcaataagtgtagaatttctatggacgccggaatatatgaggtgcccaggccagcgattgtgaggcctgggttttccattttataaaataggggaaatgcatttgaaacggcagtccggaggagaacagaatgaaattgcacgaaggcgaaataggtaagacatatattgtctacagcgtaatggtggatgacacgattacgaggcggctggaggccctcggcgtcaacgagatgacgccggtaaccctgatgaataaaaaaggcagcgggaccgtgattataaaggtaaggggtacccgtctggcgttagggcgcagaatatcagagggaattgagatcagggaggccgcagaccatgagtgatgataataggataattaacgtaggcttcgtcggaaatccgaactgtggtaagacaacgctgttcaacgccttcacaggagcaaaattaaaggtggcaaactggcctggagttaccgtggagcgggtggaaggtgagaccagctataaaggacggccgatccgtgtcattgatacaccaggaatctacagcctgacttcctataccattgaggagaaagtcacaagaaaatgcatcgaggatggggaagtcgacgtcatcattaatgtagtggatgcctcttcactggaacgaaatctttacctgacccttcagcttctggaactgaagaaaccggtaatcctagctttaaatatgatggatatcgtggaggaccgcgggatggaaattgatctgcaccgccttcctgagatgctgggttccattcctgtcgtaccggtatcagccagaaagcgtaccggcctggatgtgctgatgcacgccgtggttcaccactacgaggaaggccctcagggcacggtagtcaagtataccccccggatcgaaaacaagatttccaaggtggagacggtgcttaaggcccactatggggagatggacaatttacggtggcatgccatcaaatttatggaatacgatgagactgtatggaatgatcatccggtagatttaaataacatcattgatcataattacgagaaagagattatcaatcagaaatacgattacatagaagagatcataaaggagtgtctggtcaacaaggaatcaaaggccgcatcgaccgataagattgacgagtttttaacgcatccaatctggggaattcctattttcttagggatcatggcaatggtattctttctgacgttcactgtcggtgatttcttaaagggattttttgaagtcggtctcgactggctctcgggcagtacgctgtatttccttcaaaatattcatgcttcggaatggatcacctccctggtggtggatggcattgtggccggtgtcggcggaattctgacatttttgccgaatatttttatcctgtttctggcgctggcctttctggaggacagcggctatatggccagagttgcctatgtcatgaatgagacgatggggcgcgtagggctttccggcaaggcatttttacccatgctgttaggctttggctgcaccgtgcctgccgtcatggcggccagggctctgccgagtgaaaaggacagaagaagaaccattctgatcacaccgtttatgtcgtgttcggccagactgcctatttacgttctgtttgcggagatgtttttcccgcggcatgcgctgatcgtggcctattccctgtatctgatcggactcattatggccatagcggtggcccatgtgacgcaccggatgtcaaagggcggggaagaagataccctgttgattgagcttcccgagtataagacgccgaatatgcgcacggtggccatctatgtgtgggataaggtaaaggattacttgagcaaggcgggaaccaccatattcctggcttccattgtcctgtggtttgtgttgaacagcggaccgtccggatttgtggaggatgtttccaatagctttgccgctatgatcggacgggttctggtgccggttctgaatcctgccggccttggggactggagaatcgcggtggcgctgatatccggcctgtcggctaaggaggtcgtggtatccagcttctccgttttgtttggaattggaaacatcaattcggccggaggcatgaaccagctgtccggagttctgtcctccattggttttagcggggtcaatgcttatgcgctgatgattttctgcctgctgtattctccgtgtatcgctgcggtggcaaccatacgaaaagagaccggttctacaagatggactctgggaatggttctgtttcagctattgaccgcatggggagccgcggtgcttgtgttccagattggaagcttactcttttaatttcaataaaaatagtttgtaacgcccgaacggtaaggttgtttgggcgtttttctatacaggtatgaaaaaaattaggatctaatcaggaacaggacatggcaaaagccggattaaagcagcgagtaacccttctttaactgttccagcagagaggtgaaaaggaacggaaaatggtccgtttcatcaccgtttccactcagataacggatgatgatggtggatatctcctcaatataatcggcacatctgtggaaacaatccgctgcttcaacccagcctgcctgccgcaccataccgccttcctccgactgcaccataccgccttcctccgactgcaccataccgcctgcctccggccgtaccataccgttttctaccaaccaatccgttccgatttcgacaagcatttgggccattttgtcgaatgttccccggtaacgtatttcatccggctccgcgattcccttcagcgcattgggaactgtgggaacggtaccaaaaaatgtgaccatattcagcaggattttgtcatactcttcttttgtcagctgttttttccagtcgggaagctcgcggatcatcttttcaaggcctttgtatcccaggaaggaagcgggcggattcagaaaatgatctttttgaagcgccagagcttcggaggcaatctggttcttgctccttttttccgtcattctgaccgtacagatcgtattttcactgcttaatcctggataactgcagttcatactgtttttcagttcgtcgtatcccagggtgagaagctgcgtccggccgcagtcatagaggcagatgaggcgctgatcgtcgtcgtatcctgtcatcagtacgtaatgaaagggaatgtgctccttatggtaaagctttggataataggagagatagtacatatcgagagcccccaatacgacgggatggcctgcgtcgatttcctctttcgcctttttcagcgcccgttcaaaggtgctgtaggaatggtgtgcgtaggtgaaccctgcgatcggtgccagaaatgcatacatgtgttttgtccggccgtcgccgagggctaccatgcgtttcaagtctgatttgtctgtttttcggtagcagaaggagccaaagccagagagtagaaagaaaaatccatccgggagagattctcctgtttcattcatatagagatcttcgattccattccacatgcattcatagtcgtgggagtggtgtttcagttcaatgatttgtttcatagtacacctcgcttttcgtgattctgtttatcgtgttatcctgatcttaaaccatgacattgtgatagagtcaagaggcttttgagcgtttgtacgaccggtttatctatttttagacatatttctgtttttgtctaaaaaccatccaacttaaataaattgtataattacaaaaaggcaaaatggtattattgttaaggtcgtaaagatttgaaaagggtgatggctgtgaagacgagaaaaataagagagaaaaaacagaaaaagcgttttagtatggttgatgtgattgtacagaaaggcagatggatcgagaaaatttttgccattgcggtgattctttcggtgatatctgcctgttttgtgcatgtgaattacgatttgagcgaatacctgcctgactgggcgcctgccaaggaaggcttaaaccggatggaagaggagttcggctatccgggaaccgcccgggtgatggtggggccggtgacgctgtatgaagccaaggcctataaggaccggatcgcggagattgacggcgtggacatggttatgtgggcggatacgacgacagatgtgtacaacgccaatatctttattaactacgacgatatccaggattactataaagacggctatgcggtgatggatatcatttttgaggaaggcgattccagcagtttgacgaaatctgccatcaatgagatgcagaccctcacaggagacaagggctatttcatgggctccgcggtacagaataagtctttaaatgagacgctgatgcgggaaatcagcattgccatggctctcggtgtggtgatgatcgcggttattttatgcctcacgaccacttcgtggtttgagccggtcatgtttttgatggtcatgggaattgccattatcatcaatatgggaacgaatctgattctggggaccatatcatttctgaccttcagcgtggcctcgattctgcagctggccgtcgccatggattactcggtgttcctgctcgacatgtttacaaaggagcgggccaaaggaaatgatcccgttaccgccattaccaacgcgatacataagtcactgccctctattcttgcaagcggtgccaccaccattatcgggttcgtcgtactgatgctgatgcgtttcagtatcggtaaagacctgggcttcgttctggcgaagggaatcgtggtcagtctgattaccgtactgtttctgatgccgtcgctcctgcttcgttggggagaccggattaaacggacggagcataagtcctttatgccttccttccatggtctgggacaggtggtctacagagtgcggtatgtggttctgggagtcgtgcttctatttgtggttcctgcatttacagcccagaatatgaactcatttacgtttggaaacagcgctctcgggtccagccccggaacgaaggtatatgaggatgaacagcagatcaacgggcgcttcggcaagagcaatctgattctggccgtggttccgaacaccagcatggtgaaagagaaggatttgacggatgcgctggacgatctgtattacgtgaaatcggtgacttccctggcgggcaccataccggagggaattccggaaaaaatcattccaaagagcgcaacgagcctgctgcacacggacaactacagccgaattatgatctatgtaaagacctcggatgagagcgattttgctttccggtgtaccaatgagatcacgtccattgtacggagctattatccggaggactcctatataacgggagtgatcccttccacgcaggatatcaaatcaattattacggcggactacaatttcgtcaacctgttgtcaatcctcggcgtgggattggtggttctgatatcgtttaaatcgctgattatcccgattgtcgtcctgattcctatcgaggtggcagtcttcttcaacatggcagttccgtactttacgggagaaagcatgctgtatatgggatatattatcgtcagctgtctgcagctgggggctacggtggattactcgattctgatgacgaataattatatggatgcgagaagaacgtatcccgaaaaggcacgggcgatcaagcatacggtgtcgcgaagcgccctttccatactgacatcggggacaattctgacgattgcggggtacggcctgtatttcgtctcctctgtggctgcaatcggcggtctgggtcatctgatcggacgcggggcattgatcagcgtcctgatggtactgtttctgctgcccgtgctcctgaccatggcggatccgctgctgatgaaggaagaagctaagaaaattaagatagaggaaacgcgccaggcgatgaagcagaagaaacgggatttgaaggaacagatgaagcaaaaaacggtgcagatgatgccggggcagccaaagaataaaatggaagcggagcagatgggacccgtgaagcaagagaagaaaatggaagcggagcagatggagccggtgaagcaaaataagaaaatagaagcggagcagccgtcaaagaatattgaggatgaggtgaaggaaaatgagaaatagaagaaaaatcagatataaaattaccgccgccgcattgatcagctcgatgctcggcatgtccatggcaggcagcgcccttgcgggaccgcccgcggttgccacggatgaggcgctgtatgtgaacctggattattacggaaatcaggtggacagcagtgtggtgaagggagtttccttaaacggccttcgaacatttacggattatggaacttatacagatgtaacgaatatgtccaattacgcggaaccggtaatcagcggggacggagtcacctggcagctgccggaggactcaaaggagcggttttactacgagtgccagctgaacaacgacgaggtggttctcccgtggaattttgacgtgtcctataaactaaatggtattccaaaggaagcaaaggacctggtccatgccaatggactggtggaaatggaggtccactgcattccgaatgagaatgcaaaggagtactaccgcaacaacatgcttcttcaggtggcgaccatggttaatatggaagatgtaaacgctgtggaggcgccaggctctcagacacaggcattaggaacgtataaggttgtgatttttgccgcggtcccaggggaggagaagacctttcacatcgggatcagcacgacgaatttcgagtccatgggcctgatcatgatgatgattcccggaacgctggaccagatgagcgagatcaccgatatcaaagaggtaaaggacacagtgggggattccaccgataagctgctggatggtatgaatgaaatcctggataccctggaccggatcagcggcggcatgaatgtggcacaggcgggcctggaggatttgcagaaggcgagagcgggtctggacgcgtcgaaggacgaaatcatagccaacgcggataacagcctggacagcctggaagctgtcaatgaaaaaatcagtcagctggctccggatatcaatacgaataagcagtctctggatgaaatcaacacgagaatcaacgccatcgtgaagactctgagaagctccggcaatgacttctttgatctggcaggaaaactcagtgatctggaggactctctgggggatttgcgggatgatttgaataattccaacagggatgagattctggatcatctgcagattgtagatgaccagctggaacagatcaatgaagtgcttcagaatatcatacagactgccggaggtatccctgcggaactggatgaggaagatctgacggagcagcaggagacgctgagcaatttgctggaggagacgtatggaattctggatgacatggagtccgttgtcggctccgatgccgtggaccgcctgcgcagccagctggatgcgattaacggaaatggcctgggagacgcggccagcctttcgaagctggcggcagcggccaaggcgcttctccctgtggtttccggccttcagggcatggtgagtgatctggagcgcacactgtctggaatccgcctggacgacggccttgagagcggccaggacgcggccggggagatcagctccatcatgggccggatcgagaccttgatcggcgacgtcaatgatttaaacaggactgtcaatgaagataaagccggttttgacctgatgcttgatgacatggccgcctccctcgatcagatgagttccggcacaagtcaggtgattgcgctcttaagaagtgtgcagaacacggccaggaccaaccggagcgcggtggaaaacggtacgaagcagacccttgacggcctgatcgatattctggaaaaggctgcggataccaagggcaccagcgacaaattaaaggatgccaacgaggacttgagagccagtgtaaaggatgagctggataagatcgaggacgatacgaatctgctggaaatggacccgtctcagtccatgatttccttcacctcggataagaatccgtctccggccagcattcagattattctgcgcacagaggagatcagcgaagaagatgtgaatacgaacgcggttgatatcgaaccggttccgcagaatgtcgggctgtggcagagaattgtaaatgtgtttgtgaagatatgggatacggtaacgggattttttaagaaatagcagcctgaagcaaaaagaaaatgaaaaagccttactaacctgaggatcgtttttgggttagaaggcttttttttgtttttcagtgcgtcagatatctgcagagtatctcgacgaacatatcgaataaaaccggtgacactgcactttcctccggtgttggaggaatatacggcagtaaaacctggcggtcaatcagctccagatagggatgggaactggtcacggtaacgagcatgattttccccgcggaaccggacaacgatttcagaagagagtgcttggcactcacggagaagacgataagaagatcattttcattcattgaatcgctaagctcagagatattatcattgggaaccgcgtgaaagaaacgtcctgttttaatcatgagtgtttccagaagagaagcgggctgaaaactcttggaaacgccagtggtaaataccctgctgaattgattgatatagcagacaaggtcgcgcatataagaatctgtaaggattttttccgcttctctcagaagctggttcataactgagaaatattccaggtgatcacagtccggcatctgctgtgtcctctgctcggcaagccatgcgataagatctgcacggaaatcctgataccgtgtgtaaccaagtccttttacgaatcttgtgagcgcgggctgggagacaccacaggcgtcggacagcgcgctggtagtcatctgaacaatcttgccgggatctttggagatcttctgataaatgagctggtcattgggggtaaattctgtttttttctgttccataatctgaatgacattcatgaagtttatcattcctttccgttagttcaaatcatttttcatccatttaatataagtgatacaattatattaccatattataaaataaaaatcacttctgtaaaccaaagttttacaacaactataaataaataatttagtaaatatacacaaaaataaataaaatatttatgcaaaacaagtatttaaaaataggaacgatgatgtataatatatttatgagatacaacaaaaataaatataatattcagaaaacgaggaggaagatggaatggcagcaaactatgaaactttgcccggagatattgtccggctggttgggggaaaacaaaacattaaggggcttacgcactgtatgacgagactgcgctttgatctggcggactacagtaaggccaataccgacgtgctctcaaaaacggctggtgttctgaaagtcatcaattcaggaagccagtaccaggtcgttatcggcaataaagtcgagtcagtctatgaagccattatggaacagacgggggttcctggcggcggaatggttgaagatgctacatcagaggataaagctgtgggatcagagaagaaatcagggataatcaaccggctgatggatacgatatccggtgttctggcgccgaccttacacgtgttggcggcagccggtataatcaagggactgattgcccttacgctgacgctggggtgggtcagtgacacaagcggtctgtatatgcttttgtattcgatcggtgatggtttctactacttcctgccaattatacttggatttacggcagcgcgtaaatttaaaatgaatgaaattctgggcgctgccatcggtgcgactctggtttatcccagtatggtcaatattgcttccaatctggcggtttccggaactgtttttgctggaactgcatttgaaatgagctattataacacatttctgggaattcccatcgtcatgcctggaagcggatacacctccagcgttattccgatcattattgcagtatatgtggcggcaaagcttgagaaggcgctgaaaaagagtctgccggcggctatcaggggaatcctgactccggttattgttcttcttgtcacagtagtgtttacatacctggtaattggacctgtctccatggggatctgtggtgtgattgcaatgtttgttacattcctttacaatattccagtgatcggcggaattgttgcaggcgcgctgatcggcgggggttttggtattctcgttatgtttggactgcactgggttattatctctctggggctttccacgattgctgttcagggctttgattatatgctggcatgcggcagcatcggaccgatgatcggtatggcacagggaattgcaatctgtatagcggcagctcgtcataagaatcagaaggtcatggatctggcacttccgggaactctgtcccagatttgcggagtgggagagcctttgatgtattcggtattaattccgctgaaaaaagaattatacttaaatattttatcaggctgcgtaggcggcgccgtattggggcttctgggaaccaggatctatatgtttggcggcagcgggctgttttccttccccaacttcgtaagcgcagcgagcggtacaacggatttgatcaagtactgtatcggtgtagcagcaggctgtatctttgcatttgctgcggaactggtgatctataataacgacaaggcgaagaagcttctgtaatgaagcaggactataaagaatatgaagagaaaataaaaatgaatgacaacttaaaatttgatgcagagagaggtgagaccagaacgtatgaagcggctggtaaaaaaatcacctgcagagcttatcttggaattgtatactgtgaacggccggccgaccctgtccagaagctgaatatatttgttcccgaggcgtacagccaggggggaacggtctgcggatacacgaaggataccgctccaatctttataccgaatacggtaggcggttatctgccggggccggcggatgagccggggctgaatataagaaccggaatgcccaattcgatctttacggcactggagcatggctgtgtagttgtctccggtggtgtgcgtggaagaacctcgggaaagagaaattcagagttttttgaggggggaaagaccgatgataccggacagtatgatgggaaaatggtgggcaaagcgccggctttgattgttgatatgaaggcggttatccggtatatacgccataatcgaagtctgattcccggagataccgaacggatcatcaccagcgggaccagtgcgggaggtgcgctgtctgcgctggccggcgctgccggaaacagtcaggattacgttccttacctgaaggaaatcggggcggcagacgaacgtgacgatgttttcgctgcaaactgctactgcccaattcataatctggaaaatgccgacgcggcttatgaatggcagtttggaggtatccgtgattactaccgtacccggcatcagaagactgaaaatgggataatccggatcccggaagaaggcacgatgacggacagacagatggagctgtcacaggaattacaaaaccgatttccggcatacttaaacagcctgaatctgaaagatgaaaatggaaacagcctgaagctggataataatggtgagggaagttttctggaatatataaagggacagatcctaaaatcagccagcagggaactggcatttcatggcactgccagtcatttatcagggttggcagcgcctggcagcgctgtggatacatttccggctctgacgattctgggagaaagtgcggtcgggctggactggaaggcatatatgaaagcgattacccggatgaaaccggccccagcttttgacgctatagatcttaagagtcctgaaaatgaggaatttggctctatggaaatggaagccaggcatttttctgaattttccatggagcacacggagaccgaagcggagatggctcccgcgcagctcattcgtatgctgaatcccacgcagtacattggaaatgcggatacggcaaaacactggcgaatccgtcacggatcatttgaccgggatacatcgttcgcaattccggttatcttagcccttttacttgaaaataaagggtatgatgtggattttttcctgccctggggaattcctcacagcggagattatgatttgcaggaattatttgcatggattgacacaatctgcggacaacaataaaaaggacggaaaatacagtggagaagaagatttttggagtgaatacaatggctgttattgccggtgctctgatcctggcagcgacggcgtgcggcgcttcctctgatgatgggaagaaggaagcggcatcaaccgattcggcggccgaaactgcagcggggaaccgtgggacggactcctctgaactggtatttgaactatcgggggattctgtgaagctgacgagcggagatgagagattgacagtcgcactgaaagcgacagagggtgcgttcgccgccgccagtggagaggatgtgacgggctggtttgtcacacaggatggaaatgcagtctttacgaaccgtggagtggccacagcggaatccgtaagcgataatgggacatcaatggaaattacattagatacttccgcgattcatggatttaccgctggcggtacggcggctgtgtatgttcagccaggggagcagacggctaaggtaaacgtggggagttatacgattccggaactggatatcacccttgacgcctctgaaggagtggtggcggcaaatacctccggaatggctgcagtgaccggcgcagctgcgtattttacccttgcaatgcctgaaggaaccagactcgatgatgtgaataccgaggctgctaagctggcaatgacagacggagacggctactgcgtggatgaatttacagatccggtcatcagccttgacgcagcagcgtggtcggagggacggtatgagtaccattttgacgaagcagaagtagaaaaattgttttcgcgtgcgaaggtaagaggcagcgaatcggaggtgttcagcgagggcggccccgactggactgcatttggtggaaatggaaacgggcagtattactttaatctgaccgtaagcggactgacttatcgtggtcttccggttcctgattccacatttcgcgtatgttattacgtttacggaagagacgcttccgataaggcacgcatcaccctggctgactatatcaatgtttatgattatgaagatacgggagccgaaaagcgtactctgaatgaaagggggcaaaacgccgttttagggaatgaggccggccggaaagccggggcagagaacgggccggtatggacgtggatcggagccgattatgaaggaaaaccggtcttatgtgatacgaagcaggacgatttttttgttacatggccggaaggcgtagatgcgtcggcgctgacggcttctgatgctgcggtgacgctgtacagccaatacggggatgaactaaggctgacgccagactcggattattatgtttacagtaaagggacggagacacaaatcgcggttccctatgttcagatggcatttacgccagtttataccaatatggttattaccgtgaatcgggaggcggtttccggcgcagatggcgcagcagaagaagcgtttacgcagagctatgacattgcgtcagtatatgtctaccaggtgcagcatggcggactgaatcccaacggagcggtgctcgtttaccagttttacggctttgaggaagatacgcttacagactggaggcagttgatgcatggctttgagtatgcgctttatattgaacatgaagatggaaccagggcgtattattcggaggaaaatggaggaagccttgttgattcggcagatgccgccgccttatatgacgcagcaggcgcacaggatttaaatatccgtctctggaatcaggcggttatctatgatacgacatctgcaattgaacatgaagacggatccatgacttacagaacggagacaaagacggttaatggggaaaatgttatttttaacaaaatcgttttaactggctgggacggcaatgatcttcgcggtgtgcagatgactcccacggaggcgagagcgaatggattaaaaccggcagccgggtatgcattcccgcagacggatgatttttacgagaaatttaaagactataatttcggccatgattactgggttgcacattccatgtggccatgggtggaaggaatagagcgcggctggctgacaaatgctgacgatatgcatgcaacgtggaatggactgaacaaggggtatcactttgaatatggcagtgatggccgttatcctgactggatcgcgccggaagcggatggccgtgataactggtggccatggctcagaaatggttttcctgacgggatgtgggatgcggttgatgcagcgaatgcggatacctaccgaaaataagtgaccagattggctaagagaataaaaaaacaggccggataccaagtaaaatcaaggtatccggcctgcttttccgtaattaacaggaatgcacctgataggaatcgaacctacgcacgcagctccggaggccactgctctatccactgagctacagatgcatctttcatattctactatattttcttatgaattgcaagactatttttattgatttttatatcatagtttgttagaataaaacggagattgaatctccaggaggttaaggccggtatgaaggacttgttagaaaacttaaaaaaacgtcttgcagatgaagaaaccatccgatatttaaagtttatggtgattccgcttgttgtgattatcctgattattgtgatcgttgtggcggacaggccgcagggggaagagggagaatcgacggaagctgtttcacagatcgaaatcggaacggcggaagcgacagaagaagagaagacaggggacacagaggacaccgcatatcatctggaagaggcaggggaagagatccgcagcctgatggaggcttattttaaggcgagaaggacctgcgatatcaatggtcttgcagaggtatacggagacagcgcttcaccggaggaactgagagaagaaggccttcgtatggaggaagaagtaaaatactatcagagttataacgatattgcctgctacagcgtgaacggccctgaggaaaataccctggtggtctataccaggtttcagatcaagttccgtcagtcggataccatggcaccgagcctgtttgcctgctttgtgaagcggggagcggacggaagctggcatatgatggcggaagtcactccggaggaaggggcgtacatggacaaagtaaacgagtcggaggccgtgcagagtatggcggaagaagtcaatgtcggcctgcgtaccgcactggaaacggattccaaccttctggctgtctatcaggcactgatgagcggtgaagaggcagagagcggtgaaggggcagaaggcgtcggggaaaacggtgagagcggagaaaacggagaatccggagaatccattcagagcgaaggcaccgacggcggagacgaagtagaagcttccggaaatgaagtgacggtaaacggagactaaacgtccggaaacgaatgacaaaacatacataacaacagatgcttctctgcgtggcaccgtgcagggaagcattttgagattaaggagaagagacatgaatgtaaaagattttgattttgaactgccgcaggagctgattgcgcaggacccgctggaggaccgttcgtcatcccggcttctggttctcgataaaaagacgggagaaatcgaacaccggacgttccgcgatatcctctcttatttgaggaagggagactgccttgtcatcaacgacacgaaagtcatcccggccagactgttcggcgtgaaggaaggaaccgaggcgaagatcgagatcctgctcttaaaaagacgggagaatgacatatgggagacgctggtgaagcctggaaaaaaggcgaagatcggcacggtgattaccttcggcgacgggctgctgacgggtacggtggtagatattgtagaggaaggaaaccggctgatacagttttcctacgaggggattttcgaggagattctcgacaggctgggccagatgccgcttccgccgtatatcactcaccagcttaaggaccagacccgctatcagaccgtttacgcaaagcatgaaggatcggcagcggcccccacggcgggactccacttcacaaaggacctgctggcggagatcgaggctatgggagtcgcgatcgcccatgtaacgcttcatgtagggctcggcacattccggccggtcaaagtggatgagatcgaggagcaccacatgcattccgaattctatattgtggacgaggcggaagcaaagaaggtgaacgatacgaagaagaacggagggcggattgtctgcgtaggaaccaccagctgccgtactgtcgagtctgcttccacggatgacggtgtgctgaaggcggggagcggatggacagagatctttatctatccgggataccgttttaagacgctggactgtctgataaccaatttccatcttccggaatccacactcgtcatgctggtttcggctctggcaggcagagagcacgtgttaaacgcatatgaggaagccatcagagagcgctatcgtttctttagttttggagatgccatgtttatcaccgatcttcacgagaaagcggttccagatgttggagagcagaacggtgatggagatcaggtcggtgatggagatcaggtcggtaacgagactggggaaaggacggaaaaatgaaatcagcagaagatttgagacaatttctccgctccgttgaccggaagggatatccagcctacaagggagcgaagggtgtttaccagtttccggactttaccttaagcatcgaccatgtgcagggcgacccgtttgcgtcgccgtccagggtcagcatccgggtggagggaaagaaagcatgttttccggcagagtcctatcacctgagtcataagagggtggcgctgcaggacctgctgcttcgtaaattcgccgccaaggtggaacggtacaattttaaggcgagaggttcgggaaagagcgggctgatcgcagtcagccggtgcggccaggagattctggagagaaccgcgtgtgtggcagatccggagaatggaggcattttgatccgaatggaagtcggatttccggcaaacggaaggacgatcaattccggggaattgattaagattctgtttgaatttctgccggagtgcgtggcgggaacgtgtttttataaaacctatccggctgcagagaaggagaaggtgaaaaaagtctctgaactggcggaggaccaggaggaagcgagacggctgctttctgccatgggactcaccgcgtttgtggcgaacggatctattttgcctagggaatccggggtatcggaccggccgatggcgaaggcggttccatttacgtccccatcttcgatggaagtagtgatgaagcttcctcatgcaggggcgattaaggggatgggcatccccaggggtgtaactctgatcgtgggcggaggctaccacggcaaatccacgcttctctcagccctcgagtcgggcgtgtacaatcatatcgccggagatggcagggagtacgtcgtcacggaagcgtcggcggtgaagctgcgcgcagaggatggacggagcgtcaagaacgtggatatctccctgttcataaagaatcttccggatcggagggatacgaaacggttctgcaccgaggatgccagcggaagtacgtcgcaggcggccggtgtggtggaagcgatggagagcggagcaaagacatttctggtggacgaggataccagtgcgacgaatttcatgatacgggacgagctgatgcagatggtggtgcaccgggatcaggaaccgatcacaccatttgtggagcgggtccgggcgctttatgacgagcagggaatctccacgattctggtagccggaagctcgggcgcctatttccatgtggcggaccgtgtcatacagatggactgctatgtgccgaaggaagtgaccaaagaggcgaaggaggccgctgccgggttcggagaaggcgtccagtcgcttaaattaacgccggtttcctttgaacgggtaccgaagaagtttaagaccggaggcagggacgaacggtttaagatgaaggttctgggccgtgacagcctacagtttgaccgggacgtggtggagcttcgttttgtggaacagattgcggatacggagcagatcgcggctctgggatatctgttaaaatatgcgggaacgcatttcatagatggcaggcggaatctgattcagatcgtggacctgctggaaaagaaggttgcggcggagggccttgcggcactggcggaagacggatatctgccggttaatttatgtatgccgaggcgtcaggagatatttgcctgtatcaatcgctgccgcagtctgatgttttagggaacaggcggttagctggattagcaaaggggtcagtcatggaagaaaaaaaacatctggttggggggatttccagaaagacgctggaacgccttcctgtgtatcatcattacctggagcgcagagattccgaggggcttgtcaatatctccgcgccggtgattgcgctggatctgcagctgaatgaggttcaggtccgaaaggatatcgctatggtggcgcgttcggcggggaagccgaagacgggttacgtagttaaggatttgatcgatgacattgaggaatttctggggtaccataatacgaatcaggccgtcctggtgggcgccggttcccttggaaaggcgcttttatcgtaccgcgggtttgagcagtacggcgtggagatcgtcatggcttttgacggagacgccaaaaaggcagagcagaaggtaggggaaaagatgattcttcccatggagaaactggaaaatctctgccggagaatgaatatccatatcggcattatcacagttccggcggattccgcgcaggaggtgtgtgacaggctggtggacggaggtgtgagagccatctggaatttcgcgccgattcatctgaatgtaccggatcacgtgctggttcagaatgagaatatggccgtgtctctggcggcactgtcaaaatatctctacgaaacggataaggatgcagtaagggggaatggtgtttgaatactgtattgctgcaatatgccgtggaggttgaaaagaccggttccatcactcaggcggccggaaatctctacatggaccagccgaatttgagcaaggccataaagacgctggaggaaagcctgggagcacccattttcaagcggacgcccaagggcgtcgtccctacggccagaggcaggatctttctggaatatgcgagaaatgtgctggctcagttagaggagatggaggcgctttataagcctgcgaaggcaggcggtgtggagttcgctctgtccatgccccgggccagctatatcagctatgcattttccctgttcgtgaagcggattggccggaaggaaggcatgaatctatggcttcgggagacgaattccgccgacactctgcgtgatgtggaccgtggagagtataagctggggatcatccgctataaaccgtccgcagaggcatattacgccaagcaggccgcggaatgcgggctgaagacggagcttctgctggaatacgatgaacgcctcctgatgtcgcaggcccatcccctggccttagccggacacatagagccaggcgatctgctgccctacatcgagatcacccatggagacggcagcgcctccggccatcgggaatttaaggccgcggacagcccgccggccaacaggatctatatcttcgagaggggaacccagatggggcttctccatgagaacagcgacacctatatgtgggtatcccccatgccgccgtctgtcttaaggcagcacggactgaccgagaagccgtgtgcagacggaaatcaccggtaccgcgatgtcctcgtctacagaaatggttataagatggggaaatgggaacggctgtttctggaagagctggagcaggtaaaggcaggcctgatgggggaactttaatcagtatctatatatcgatatttatatactgatatatgggaatttacatttgtattttttcctccctgagtctacaataagatcagcataaaaatatggcgaggaggattttactatggcaagattcacattaccaagagatctgtatcatggaaaaggagcccttgaagagcttaagaatttaaagggaaataaggcaatcgtggtagtaggcggcggctctatgaagcgttttggctttctcgatagagtaatcgactatttaaaagaagccggcctggaagtgaaattatttgaaggtgtggaaccggatcccagcgtggataccgttatgaagggcgctgagatgatgcgcgagttcggtccggactggatcgtggcgatcggcggaggttctccgattgatgcggccaaggcgatgtgggcattctatgaatatccggataccacattcgaagatctgtgcattccgtttaacttcccgacactccgtacaaaggcaagattctgtgcgattccgtcaacctccggtactgctaccgaggtaacggcattcagcgtaattacggattacaacaagggtatcaaatatccgctggctgacttcaacatcactccggacgtagcgattgttgatccggatctggctgagacgatgccggccaagctgaccgcgtttaccggtatggatgccatgacacacgctatcgaagcgtatgtgtccacgctccactgtgattataccgatccgctggcgcttcatgccatcaagatgatacataacgatttaatcgattcctataatggagatatggctgcccgtgaccgcatgcataatgcacagtgtctggcaggaatggcattctccaacgcgcttctgggcattgttcattccatggcccataagacgggcgccgcatattccggcggccacatcgtacatggatgtgccaatgccatgtatcttcctaaagtaatcaggtttaacgcgaaagaaccggaagcggcaaagcgttacgctgagattgcacgtttcattgacctcaagggttccaccgatgaggagcttgtggatgcgctgatcgcagaactccgcgggatgaatgagaagctgaatattccaacctgcatcaaagagtacgaaggcggaatcatcgatgagtcagaattcaatgaaaaattaccgtcagtagcagagctggcagtcggtgatgcatgcaccggatccaatccgagaccgattacaccggccgaaatggagaagctgttaacctgttgttactatgataaagaagttgatttttaaccttttatttagcaatgcaatgtgtgccgggggcgcaggatcgtatggtcctgcgcctctggtgcgtgaaaaaggtttcagttgtctgagcgcagcgagtttgggaattttccctggtttttagaaaaattctgcacgtttagaagtgcttatccccgaaaccggaactggaaaccacccataagccagccggggcagaccgggaagcagagatcgacagggctgtgaactgaaatcgaaaaagctgtttgacaccgttttttatctgtgttatggtatcagggaatcaaaaaagaagggacaggacggaacggatgaaaaaagaggatgcagtgctggtggtcagctttggaaccagttataatgacagccgtaagaagaccatcgaggagatcgagaagacgattgccggacattttcaaggttacgagttccaccgggcgtttaccagccgggtgattattaatattttaaaaaaacgggattccatttcgatcgacggagtgtcggaggcgatggaaagacttttaaatcagggcataaaaagggttctgatccagcccacccacgtcatgagcggcgaggaattcgacgccatgatggaggagatgagtccctatgaggcttcctttgaggcagtggccgtaggcgccccgctgctcacttcggatgaagactatgagcggctcgtccgcattctggcagaggatacgaaggaatttgaccaggagggaacggagatcatactcatgggccacgggacagaacatgcggcgaatgaggtctatgtgcgccttgccgcggaatttaagaaacagggatacggccggtaccatgtcgggactgtggaggcgacgccctcgctggaagatatgaagcgcgaggcggatcagacaggtgcgcgccgggtggtgcttcagccgctgatgatcgtggcgggagaccatgccaataacgatatggcaggcgacgaagaggactcgtggaagagcgtatttcaggcggacggatacgaggtggtgtgccggctgaaggggctgggagagctggaagggatccgcagaatgtttgtagatcacgcgaaaatggcggtgcggtccttgactttaaaatagcgctttgctagaatgacactattcgttatataaggaaaaggacaggtaatatgcaaaaaagaaagagaatggcggctgccgcggtttgtcttgcggctgccgcttccatctggctgctgtcgggatgcgccagaaagatcgaaccaattacaaagtccagttttatgctgaatacgtttgtaaccgtgactctgtatgatacggatgatccggacctgttaaacggcagcctggaactgtgccgttcctatgagaatatattcagcagaaccatcgagggaagcgagatttacaagctgaaccaccgttctgcggatgaacagaccgtgaccgtctcagacgatgtggcggctctgctggaaaagggaattcattacagtgaagtctcggacggggattttgatattaccgtcgagccgctcagctccctgtggaatttttcgtcggatgaacatatagttccttcggatatcgagatcagggaagccagggacaaggtgaactggaagaatctggagctggctgggaatacccttacgtttggctcgccggatacggccattgatttgggggccatagccaagggctatattgcggaccgcatgaaggactatcttgtcgaaaagggagtgaagagcgccgtgatcaatctgggcggcaatgtgctctgtatcgggaaaaggcccgatggaacgccgtttaaggtcggccttcagaaaccttatgcggaccggaatgagacgattgcgacgctgaacatcgacggaatgtctgtcgtttcatccggtgtctatgaacgccattttgaaaaggatggggtgaattatcaccatatattaaatcccagagacggatatccgtatcagaacggactcatatcggtaaccatcatctccgatctgtccgtggatggggacggcctttccacgacctgcttttccatgggactggagaagggaaaggacctgctcgattccatcgacggcgcctacggcgtgtttatcaccgatgactatgagattgtatattcggagggagcgaagcagttcctggataaagaatcttaaggattcctttattcatggggatttgctttacatttttccggcactatactacaatagaagaaatgtaattttgacaggagcagtgttatgattaaaaaaatatgggacaaggttatgaaccgagaggtcatttcttatctgatcttcggggtgctgaccacactggtgaactgggtggtctatgcggccatggtaaaggttcatatcgattaccgcatagcgacagcggtggcatgggctgtatctgtcttgtttgcgtttattgtgaataagattttcgtatttcagagctataatatgcgcccggcctttgtaatgaaggagatcacgtcgtttgtggcgtgcagagccgtgtcgggtgtgatggagatggtctttatgattgtcatggtatcatggattcatatggacgagtatatcagcaagattgcagtttctgtgattgttgtaattgtaaactacgtattcagtaaactttttatattcaggaagagcgaagaaaaatccctgtgaaaggttggccgaagtacggccaggtaactgcatatggaacgcgatgacgagattgaaaagatttctaaagaactagaggacatactaagaatgacatcagagaaaaaacggagcagtggggaaactgagacggagaagaaaaatttgataccttcggagaatgggacggacgaaaaagaaccgtccgcttccctggaggatttttcacttatactggacctgggcgaaggctatacggtgtcgtcggattctgtagcggacgcgtctgaccttgaacatggggaagcggaagtgaaggccggtgcgggagatagaacggatttgggagacaggacagattcgggagacagaacggattcgggagagagaacggattcgggagagagaacggattcgggagacagaacggattcgggagacagaacggatttggaagacagaacggattcgccggaactgtgcgcggaccccggtgacagcctggattcctttgacctgctgggcggtcagacggcggctgaaggggaatacgaggattctctggaactttttctggaacccgtggaagaggaagaatacgaatacgatgaagacgcagaatttccggatcgggaagacgccgggtatgcagcccgtgatgagggcctgtatccggattcggaaaaaccggtccgtggtgaccatacccggaaacggagacgggacggcagagagagcatcagcctgatacggccatcggatggacttgtggctgcattttttgtgccgattattattatgatcattatctttgcccagcgcggaatctttccgtttggggaggagagcttcttaagaacggatatgtaccaccagtatgcgccgtttttctccgaatttcagcacaagctgacccatggcggcagcttcctgtacagctgggatgtgggaatgggcgtgaatttcgcggccctctacgcctactatctggccagccccttaaactggcttctggtgctctgtcccaaggcgtatatcatcgagttcatgacctatatgatcgtgttcaagatcggtctcagcgggttaagcttcgcctactatctgcggaagcactgcagaacctcggatttcggtatcgcatttttcggcattttttatgcactttccggttatatggcagcttacagctggaatatcatgtggctggactgcatccttttgttccctctgatcatgctggggctggagcgcctcgtccggaaaaagaaatgttttctctattgcattactctggggttatctattctgtcaaactattacatatccattatgatatgtatttttatggtgctgtactttatcgccctgcttgtgatggatggaaagaaatcgtggaaggattacatggtaaatatcagttccttcgcggtgttctcccttctggcaggcggtctggccgcggcagtgctccttccggagatctacgcgctgcagatgaccgcgtccggagattttaactttccgaagacggtgacctcctattttccgatctttgatatgctggcgagacacttgccggatgtggagacggagatcggactggatcactggccgaatatctactgcggcgtggcggtccttatgctgtttttgctgtatctcgtaaaccggaagatcaaacggcgggaaaaagtggtgtactgcggtctgctgctgttcttttttgccagcttctcgttcaatgtacttaactttatctggcacgggttccattatcccaacagccttccgtgccgccagtccttcatctatattttcctgatgcttctgatgtgttatcaggcgtacagccatttgaaggagacgccgtggaagcatgtggtgctggcgttctttgcggcgatcgtatttgtgctgatggctcagaagctgatcacggatgaagcgtaccatttttctgtgttctatgtggcgattctattcctttccgcctatgcggggctgatctgtttgtatcagaagggggtcaaccggaatctcgtcatcctgctggcgctgggagtcgtttcggtggaagcggcggtcaatacgacggtgacgagcgttaccacgaccagccggaccagctacgtaaaggataatgacgccagcgtgagactgacggaagggatcagcgatccctccttttaccgggtggaaaagatcaccaggaagacgaaaaatgacggcgcgtggatgaatttcccgtccgtatccctgttctcgtccacagccaacgcggacttatcaaagttcttcaaaaagctgggatgcgagagttccaccaacgcttacagcatcaccggcagcacgccgctggtggattcgttgttttccgttaaatacgcgctgtattcagagacaccggccgacaccggtctcctcactccgatggaggtggaggatcatacgtatctctaccgcaatgaatttacgctgccgttgggagtcgtggtcccttacgatcttgaggacaactggcagttagacatcaccaacccggcggatgtacagaacgatcttgccgtggtgctgggagccagccctgtgctggaggaggtgccgagcgagattctcggaaccagcttcacctttacaccggaggtatcgggcgattattacgtctatgtgagcaacaagaaggtggaaaaggtaagcgccctgatgggggaaaatacgaagagcttcgacaacattaaccgcggatacatgctggagctgggatggatttccgcaggcgaggaagtgacgctccgcaacgatgacaacgagcaggatctggttgctatggcttatcgatttataccggaaggtctggaatcggtatacaatgtgttaaacagaaattccatggagctgacgaagaagacagatacggaaatctccggaagaatcgaagccgaaagggcgggtctcctctatttgagcattccttacgacaagggatggtccatattggtggatggagaagagacggagccgtataagctgttcgataccttcttaagcgtgcggctcacggccggaacgcatatcgtggagctgcgctatatgccgcagggcttaaagacgggcggaatgatcacggcaggcagcatcgctgtgctgcttctcattgcaggaatcaccgcaggccgcagaaagaaaccggtcatgcgcagaagaataaaatgctaaggagaaatgaaatatgaaattatggggcggacgcttcacaaaagagacgaaccaactggtacacaatttcaatgcttccctttcctttgaccagaagttttaccatcaggacatcgaaggcagcattgcccatgtaaaaatgctggcaaagcagggaattctgacgacagaagacagagatgcgatcatagaggggctggaaggaatccgcagggatttagagagcggagcgcttgcatttacggcggagcacgaggatattcattccttcgtggaggcggtcttaacggagcgcatcggtgaggccggaaaacggcttcacacaggcagaagccgcaacgaccaggtggccctggacatgaagctgtatacgagagacgagatcgatgagctggacggtctggtcaaatcccttctggaagagctgttaaagctgatggaggagaatctggacacgtatatgccgggctttactcatttgcagaaggctcagcccatcacgctggctcaccatatgggggcctactttgagatgtttgaccgcgaccgttcccgcctttccgatatcaggaaacggatgaactactgtccgctgggatccggcgcgcttgcaggcaccacctatcccctggaccgggagtatacggcggagcttcttggatttgacggaccgacgttaaacagcatggattccgtggcggatcgtgattacgtcattgagctgctcagcgcgttgtcgacgattgccatgcatttgagccgcttctgcgaggagattatcatctggaatacgaacgagtatcagttcgtggagatcgatgattcctacagcacgggaagcagcatcatgcctcagaaaaagaaccctgatatcgcggagctgatccgtggaaagacaggccgggtctatggcgctctcgtctccattctgacgaccatgaaggggattccgctggcctataacaaggacatgcaggaggacaaggagctgacctttgacgccatcgatacggtaaagggctgccttgcgctcttcactggcatgatctcctccatgaccttcaagaaggatgccatggaagcgagtgcgaagaatggctttaccaatgcgacagatgccgcggattatctggtgaaccacggagtggcgttccgtgacgcccatggaatcgtgggacagctggtattgtactgtattgagaaggggattgcactggacgatatgtccctggaagaattccaggcgatcagtcccgtgtttgaggtagatatttacgacgccatcagtatgcagacgtgtgtgaaaaagcgtatgaccatcggcgccccgggacaggatgcgatgaagaaagtgatagaagcgtgcagagagaggctggaaaagtaaaatccatatactggaaatttcctcagaaaaactattgcattcctctataggggaaggtttatactaaagtatattagatgatttatacgtgagggtaaacaaaatctgatcagaggaggctgtctggtttgctatgggggaaaggcaaaacgctaaaaaattatattctatcggtgaagtaagccgtatctgcaatgtgtcgaaaaaggcacttcgcttttatgaccagatcggagtgatctctccggatatggtaagcgaagagaacaattaccgctattacagcgaggagacactgcttctggttccggtcgtcaagtattataaacagatggggttcagtctggaacagatgcagagtctggtggaaggcagtacgtatcaatgcctggagcgaagttttttaagcaagagtgaggaactgcagaccgaacggcaggagctgttataccgctataccgccgtgaaggactggtatgagctcgtccgtgaggcggagcttgtttcccagcgcaaagaacacgatgtgacgataaaatatgtgaattctacggtgtattgcagtaaagaacaggatttttcatacaattacatggaatcgatcatcaatattccgtgggtgaactatctggaaagcatacataacgagatcacaggaccggttatcttaaatttcccatcgtttcgtgagaagcgggatgggacatgcaggcgggccaggattatgcagatgccgctccgcccgctggtaaaggatgcggaactaaagacgctgggcgggaccatgatggcttcggtctatcacgtgggatccctggatacaatcggacgggagtacgggaagattgaggaatgggcgtcgagaaaaggatatgtctgcggcgaggaatcgtttgaacggtatgtggtggattactggacgacgcgggtgccgtcggagtttgtgacggagatactggtgccggttacccggatggaagagtgcagataatttgtgtaaattgaataatatgatgccaaaaccttcccctcaaggggaaggtttgaaggagacaaccatagcttcgcagggagatggttgtctttttttatgcaaaattacgctgtatcatggtttgacggtattgttattgttttaacattaccctaaggggaaggtacattatgcagatttacctgcattatactaaaaaatatttagaaaacaaaacaatagtaagcataatatgaaaatattttagaaaaatagcgtaaaaaatgaggcttgacattccacatagggggagggactatactaaatgcatataaaaaagatggattaaagataaaaattagataatgtatctaattttcaaatccagaaggaggatatttcatgaagtacgatgcattgggaatgattgaaacaaaaggactggtaggatcgatcgaagcggcggacgccatggtaaaggcggcgaatgtcaccttaatcggcaaggaacacgtaggcggcggtctcgttaccgttatggtgagaggcgatgtcggagctgtaaaggctgcgacggatgcaggagcggcagcagcacagcgcgtaggcgagctggtatccgttcatgtaatcccacgtcctcatgcagaagtggagtgcatacttccagtctgcagaaaaccggaataggaggaggtcgcgtaggtgagatattacggagaagaggcactgggcctggtggaaaccattggcctgacacccgcgctggaagcggcggataagatgttaaaggcagcggacgtggaactcatatcctacgaaaacgtaggttccacccttgtgaccatcatggtcaagggagatgtggcagcggtacggtcctctgtggaggccggagcggcagctgcggcagccatcggaaagctgacggctaagaatgtaatggcgagaccgattcagggagtaggcgatattgtatccgtacacgatgttgatgcgtaagaacagataaacggcaggaaggaaaaattttatggaaagatatgaagccattggttccattgaaacatttggcctggtattcgttctggaagccgcggatgcgatgtgcaaggcggccgatgtggaactgattggatatgagaatgtggcttccggatacatttccgtgctggtgcgcggtgatgtgggagcatgtaagacggcggtagatgccggagtaaaggcagtggaagctatgggagccgaggtttacagctctgtcgtaatcccgaggcctcatcccgatctggagaagatcatcacacgttactccttaaagaatcttcttccggcggagtaaggaaaggaagcgtaggcaatgcgttttgttgataaagacttgctttctgtccaggaagccagaatcctgatggaaaatgccggagaggcgagaaaagtgctggctggttttgaacaggaaaggctggaccgcattgtggtacatatggcgcaggcggcggcaaaacacgccagggagctggcggtcatgtcctgcgaggagacggaatacggaaactggcaggataaatacaggaaaaaccggtatatctgcgaatacctgcccgagaagcttaaggccatgcgttttgtgggaatcatttcggaggaccgggaagagaaaatgatgaaggtcggcgtaccgttaggaattatcgcagcgctgacaccgtctaccaatccggtatccacggccgtctatcaggcgctcatcgcggtgaaatcaggcaacgccatcgtcttcgctccccatgagcgggccgcgaagaccacgggcagagcgctggatattctgatggaagcggctgctgaggcgggacttccggacggcgcgctctcctacttaggcaccgtgacgcgtcagggaacggaagagctgatcggccatccggccgtatcactggtgatcggcaccggcgttccggagatgacagaggccgcgaaggccgcgggaaaaccgttcatctatggaggaaccgtaggttcccccgcgtttatcgagaggacggcggacataccgagggcggtgaaggccatcgtggccagccggaattttgattacggaatcgtgccggcggcggaacagtatatcgttgcagacagctgcatcgccggtgaggcgaaacgggaatttgagagaaacggcgcctacttcatgtcgggggacgaggaaaaacagctgatcgggctgctttgtcccgaaaacggcagccaggaccctgagctggtgggtaaaccggcgcgggagctggccagaagggcgggattttccgttccggatacggtaaaggtactggtctccgaacagaagtatatttcagacagaaatccatacgccagggcgctgctgtgtccggttctggtgtattacatagaaaatgactgggttcacgcctgtgagaaatgcatcgaactgctggcaaatgaaagccatggacacacacttgtgattcattcgaaggatgaagaggtcattcgccagttcgcactgaagaaaccggtcgccaggatgctggtgaacaccccggctgtgttcgggagcatgggtgtgacgacgaatctgtttccggccatgacgcttggaagcattaccgccggggtcggaatcacctcggacagcgtctcccccatgaacctgatttacgtcagaaatgtgggatacggagtacgggagatcgaagaccggatggctggagacgcagagcagaagaacggccgcgccgatgccgcggttttaaacacaacccgacagacggcggtcccgaaaggcggggatgacagcctggatgacgagctggagcgggccatgaagaagctcctggagtggatggccgaagaagaataagcaggaaagaggggtaatacaaattggatattcgtgagtttacagataaatttgcagatgcgaccagaaacatgtcgccggaacagcgggaggcgctggtaaagatgctggaatccgtttccggcgatctgccaaagggcgctccggagaaaacgggagtatgcagcggcgagggcacagagattcccgatgggatcaccgagcgtcttcagcttctgaaggataactacttaaagcaggttccttccatcacgacttaccgtgcgagagccattacgaagatcgcaaaagagaatccgggcatgccgaagattcttctgcgcgcaaaatgcttccgttactgctgtgagacggcgcctctggtaattcaggaccatgagctgatcgtcggagcaccatgcggagcaccgagagccggagcattttcaccggatatcgcctggagatggatggaagacgagatcgacaccatcgggacgcgtgcccaggatccattctacatttccgaggaagacaagaagatcatgagagaggagctgttcccgttctggaagggcaaatctgtcgatgagtactgcgaagaccagtaccgggaagccggtgtatgggagctctccggcgagtccttcgtatcagactgttcctaccacgcgttaaacggcggcggagattccaaccccggatacgacgtaatcctgatgaaaaaaggaatgctggatatccagagagaagcgaaagagcatttggagcacctggattatgagaacccggacgatatcgaaaagatctatttctataaatctatcatcgataccaccgagggcgttatgatttacgcaaagcgtctgtctgattacgcggcggagctggcggcaaaggagacgaatccgaagaggaaagcagagctcttaaagatttccgaggtcaacgcccgtgtaccggcccataagccggaaaccttctgggaagcagtccaggcggtatggaccatcgagtccctgctggtcgtggaagagaaccagaccggtatgtccatcggacgtgtggaccagtatatgtatccgtactataagggcgatatcgaatccggacggttaaatgatttccaggccttcgagcttgccggatgtatgctgattaagatgtcagagatgatgtggatcaccagcgagggcggttccaagttcttcgccggctaccagccattcgtcaatatgtgcgtgggcggcgtgacgagagacggccgtgacgcaaccaatgaactgacgtatttactgatggatgctgtccgccacgtgaagatttaccagccttccctggcctgccggatccacaacaaatctcctaagaaatatatgaaaaagatcgtggacgtaatccgttccggcatgggcttcccggcctgccacttcgacgacgcccacattaagatgatgctggcaaagggcgtgagcattgaggacgccagagactactgtctgatgggatgcgtggagccgcagaaatcaggccgtctctaccagtggacctccaccgcctatacccagtggccggtctgcatcgagctggtgttaaaccacggcgttccgctctggtacggcaagcaggtctgcccggatatgggagatttgagccggttcaagacttttgaggaatttgacgcggctgtaaaggaagagatcaaatacgtgacaaaatggaccgacgtggccacggttatttcccagagagtccacagagaccttgctccgaagcctcttatgtccatcatgtacgaaggctgtatggaaaagggaaaagacgtttcctccggcggcgcgatgtacaattacggacctggcgtaatctggtccggccttgcaacctacgccgattccatggcagcgatcaggaaactggtattcgatgataagaaatatacattagagcagttaaacgaggcgttaaaggctgatttcgttggttacgaccagatcaaggccgactgcctgggcgcaccgaagtacggcaacgacgatgattatgcggatgatatcgcggcggatttggttgatttcacagagaaggagcacaaaaaatataagactctgtactccaacttaagccacggtaccctgtccatttccaacaatactccgttcgggcagatgacaggcgcttccgccaacggccgcggcgcatggctgccgttatccgacggcatcagcccaacccagggagccgactacaagggaccgactgcgatcatcaagtccgtgtccaagatggccaatgacagcatgaatatcggcctggtacataacttcaagatcatggcgggactcctggacactccggaaggagaggagagcctgatcaccctgcttcggaccgccagtatcttcggaaacggcgagatgcagtttaactatctggataacaacacgctcttagaagcgcagaagcacccggagaaataccgcgacttaatcgtccgtgtagccggatacagcgccttcttcgtagaactttgcaaggatgttcaggatgagattatcagcagaaccatgctgacccatttataaagaaccgtaaattggagatgaataacgatgaatcagacacatgcaggttccattgagcgcaaggcactgatattcaatgttcagaagtataacatgtacgacggaccgggcatccgcaccattgtgtttttcaagggctgtccgctgcgctgcaaatggtgttccaatccggagggaatggaccggagttttcaggtcatgtttaagaaacgttcctgcgtggactgcggggcatgtgtaaatgcctgccctgcagggattcacgtgctctccccggagaccggaaaacacgaaatccgcagagacagagactgcaccggatgcagaaaatgcatggaggtgtgcccccaggaagcgctgacgatctcaggtgaatgtaagaccatctcggagctgttaaagattatttccgaggatgaggccttctacgagcagtcgggagggggcgtgacactgggcggcggagaagtaaccgcgcagccggaggcggccttaaaccttctgatggcctgtaagcaggaaggctataacacggcgatcgagacgtgcggcttcacgaaaacagaaactattttaaaaatcgcggagtatgtggacttatttctgttcgatatcaagcatatggacccggaacgccacaacgagctggtcggtgtaaacaatgagctgatcctggaaaacttaaaggagcttcttcaccgccgttacaacgtcaaggtgagaatgcccatgctaaaggggatcaacgacagcagggaagagatcgaccgggtaatccagtttttgatgccgtttcgtgattataagaatttcaagggaattgatctgctcccataccacaagatgggggtaaataaatacaatcagctggaccggccctatcccatcgacggagatcccagcctgagcgacgaggacttatcgcggatcgagggctggctgaaggagtatcagttccctgtcactgtggtaagacattagcggagtcggtatacagcaggaaaggagagccatggcgggaaatgaacttaccagtgtaagccgggtgatcgaggaatccgtacccggcaagcaggtcacgatcgcccatgtgatcgcatcaccggtgccggaggtgtacgagtgccttggaatcgacgcggcgggagccatcggtatcctgacgctctccccgtttgagacggccatcatcgcggcggatattgcggctaaggcggccgatgtggaggttggatttttagaccgcttcacgggatcggtggtcatagccggagatgtccagagcgtggagacggctcttgtctccgtctgccggacgctggagaccgtgcttggctttgccgtgaccccggtgacgagaacatgagaacaaagagaattatggtaatgggggctggcgggagcggaaaaacgactctggcccatgcactgaatggggatcactctccggtaaagcggacaccctgtctggtctacggagcacggacgatcgatgctcccgccgcctacttagaatctccctggatggtacagcacctgatcgcggaggcccagaatgcgtctcatgttctgatgctggtggatcagacaaagacgagggaggtatattcccccggttttgccctggccttccgtgctccggtcatcggagtcataacgaaggaaggaaagagccgggagcagctggcccggtgtgaaaaggagcttataaaggccggagtccagcctccgttttaccgggtggtgtttccttccggggaggggctccttgaactggaaaaacggctgagcagtaactaaaattcaggagaaaggaggcggaaataaaatggaacagtttattatgaaaacaaaagtgtatctcggggaagcttctctggaaactctccgggatatgggaataaaaaaggcgttcgtgatctgcgatccgtttatgaagagttctcataaagtggatatggtgacggatctgctggaggaagcgggagcggaattttctgtttttgctgaggttgtaccggatcccaccattgcggtggtgtctaaggccatcgagcagatgctggtatgcagaccggacgccgtgattgcgctgggcggcggttcagccatcgatacggcaaaggcggcaggcctgctttattccggcatgagccagtcggagcgtccggaactgattgcaattccgacgacgagcggaacgggaagcgaggttacctcctttgctgtgatctcggacccggaaaaacaggcgaaatatcccctggtggacgattccatggtgccggatacggcgctgttggacccgcgttttaccgtttcggtaccaccccatattacggcggataccggcatggatgtgctgacacatgcgctggaggcgtacgtttccacagatgccggtgactttacggatgcctgtgcggagaaagcgatccggctggtatggcgttacttaaaaactgcggtggaagacgggagcagcatggaagccagggagaagatgcataacgcgtcgtgcctggccggcgtggcatttaacggggcatccctgggaatctgtcacagcctggctcacgcgcttggcggaagatttcatattccgcacggaagaagcaatgcgatgctgctctgccatgtgatcgcttataatgcggggctggatactccgggagagacggcggccctgaaacggtacgtggaagtggccaatatgctgggaatctcggcaggaaccgacaaggcgaccgtacacggactgatccgtcagatcaggattctgatgaatcagatccatatcccccagtatataacggaatgcggtgtggacagagaggaattcctggaggccgcagacggtatggcacagcttgctttggatgacaactgtacggtgacgaatcccaggaagccgtctaaagaagaactggagaacttataccggtgtctgtgcaaagggggatattgatgaaatatataaccgaagcggatttgagaaatttataccgcaccaccccttttacaacgtatgaaacggaaccggggacacggctgacgccgggagcgaggcagttcctgggggaccgcggaatcaggattccggatgagataccttccgcaaagcggttcggggacagtggaaccggaggaaagaagccgctgtacttctggagacaggaggaaaataaggcggggcatgatacggaccgtattggtgcagatgcagaagaaaacgcagcagcgacggacagccgggaaggtgaggagcgatgtccggaggatttgaatatcactccggaaaaaatggcgctcttaaaccgccttaaatcggcgcaggccttatttttggaaacggggcttcagtttaaggagcacgacgtgcttctggcccagcgaatcttcgtcatggagcgctgccttgcggggctggccgcagaggaggaaatgtgcctgctgccgtgccaggcgtgtactggaatctgcccggataatttttccgaggatatggaggactgcttcgagattacctccttccacgtccagtcagaccgggggatggatctgatccggcttcaccggctgcgctgtcttctgcgggaactgagccctttcgtggagcaggagctgggagacggcaaaaaacgggagcttcatcaggtgattaatggtttatcccagttaatatgccagttatttggaggaaatacatgtcaaaagaaggaataacatttgaggaatgcgacagcctggtaaaggagtttgagcgagtcgttaaaaacccggtaacaaacggttcttccgtctattacaccggagtggatttgggaacggcctgtgtcgtagtggcggttctggatgaaaactttaagcctgctgccggcgcttaccggtatgccgacgtggtgcgggacggtatggtagtggattatatcggtgccatccggatcgtccgggagatgaaggcggaactggaggaaaagctgggctgtgagcttttatatgcggctgccgccattcctcccgggaccgacgagctggattcgggagccatcaaaaatgtggttcagggcgcgggctttgagatcacggctcttctcgatgagccaaccgcagccaacgccgtgttaaagattaagaacggcgcggtcgtggatatcggaggcggaaccactggaatcgccatcttaaaagacggaaaggtggtttatgtggcggatgaggctaccggcggaacgcatttttcactcgttatttccggggcttatgggcttcccttcggggaggcggaacgctataagcgggacccctcacaccataaggagctgctgccggtcttaaagccggtggtggaaaagatatcttctatcatcaaccgccatttagaaggccatcaggtggaaggcatctacctggtgggaggaacctgctgcctggcggggattgaggatattattgaaaagaggacgggaattccgacgtataaaccggataatcccatgtttgtaaccccactggggattgcacgaagctgtacccaggaagccagtgaatgagatgaggtaatgtgacatggaaatcagaatcataaaatcaccggcgcacggcaccctcgatatcctgttaagaagaaagggatcgggagcatcgacacccatcgagtcggtggatgcggtcgggctggttcagggccggatgattgagatggtgtgcgccgccgatgtggcggaaaaggctgtcggagttaccgtggaagacattcgcggcaactgtcctcagaatatggtgctgctggctattttcggggataccgcctccgtggaagcggcccttgaggaaattaagcggaaagagaaagaggggacaccggaatggtaactgcaaagctgatcggcaatgtctgggcgaccagaaaagcggaatccttaaacggatttaagtttatgatggcggagatcatcagcgggacgaggacgggagaacgaatgattgtggtggacacaatcagcgccggaatcggtgaccgggtgatcgtcacgaccggttcttccgcgcgccgcatgctgggtgacgacgggattccggtggacgccgtggtagtaggaattattgatgaagattgtgaatttatatagaagaaaccggtgcagcgctgcacttgtgttttcaaatggatagattcgcagagaagaagggatgtggtaccatgaaaaagttagtttgcgccagggatattgaagagtgcagcaaacagggaaagaccgagtactgcgtggacggcgatacgattatcacaccttccgcaaaggacgcggccgaggcgtgcgggatccggtttacggatcgtataagccagccggaagcggtgtgtgccagtgcgttcgcgggaatggataagatggatgcggccggactctgccagctgttaaagaccatactggagcagggcggtttacaggcgccgtctaagccttatgaagaggagcgctacggaaatggcttaaaggtagttcggggcagaacggtgaaaatggatgtgtttgacaccggaaacccggatgcgacggcgtatttccaggaactggtaagcaaggatgaatcccatatcagcgccgggttcctgattattgaaaactcgaaatttgactgggaactgacctatgaagagatcgattacgtcatcgaaggcacactgacgatcaccattgacggaaagacgtataccgctcacgccggagacgtgctgttcgtaccatcgaattccaaagtcgtatggggatctccagacagggcgagagtgttctatgccacttatccggccaactgggcagatttgctgtaaggaggtaagccatgaaggcacttggactgatagagacaaagggcactctggcggcggtggaagccgcagatgccatggtaaaagccgcggatgtcacactggttgagaaaacacgagtcggcggcggcctggtgaccatcacggtgaccggtgatgtggccgcggtacaggcggctgtggacgccggtgtggcagcagtggaacggatcgcggcctccagcctggcggcaagactggtcattccacggcctcatgaggagctggaaatcctgtttacaccgaaggggcctggcggaaagacggatcctggtgtgagggacgaggaagagctggaagcagaaggcgcagctgtgggagaaacggttgaagaagtggttggagacgtggttggagaagtggaagaatccccccaccctgccctcccggagaagctggaccggcagaccttagattccatcattgaaaaatacggcattgccgaaggtatggcgatggcggacggactgaaagtaacagcgttaaggacactggcccgtgaatacggagaattgaagatttccggcagggaagtgtccaaagccaataaacaactgctgctggaggaattaaagagctattacgaagctcgaaatgattgacgcggttcttcgcgggaacaaaataatagaaaaggagatcctgacaatggaaaactttgattttgatttacgttccatccaggaagccagagatttagccagaaaaggagaaatcgcggcgaaaaagatggctacctactcccaggagcagatagaggttatattacagaatatggtaagagcagcagaggaacacgcggtctgcctgggtaaaatggcagcagaggaaaccgggttcggtaaggcggaggataaagcctataagaatcacgcagcctccactctgttatatgaagagataaaagatatgaagaccgtgggaatcatcgacgaggacccggtaaaacatacgatggatgtggcggcgcctgtcggtttggttatgggaatcgttccatcgaccaacccgacttccaccacaatctttaaatccattattgcggtgaaatcaggaaatgccatcgtcttttccccccatccgtctgcggcgaaatgtacactgaaagcagcagaactgatgcgggatgcagcggtggaggcgggggcgccggaggacattatcggctgtgtcaccatgccgaccatgggagccaccaatgaactgatgaaatgcaaagaggtaaacttaattatcgccaccggaggccccggcatggtgaaagcagcgtacagcgccggaaaaccggctctgggcgtaggcgcgggcaactccccggcatacatagagcggaccgccgatatcaaacaggccgtaagcaacatcatggccagcaagaccttcgattacggaacgatctgcgcttccgagcagtcgatcgttgtggaagaatgcaataaggacgcggttgtcgcagagttaaagagccagggagcctattttatgactccagaggagacggagaaggtgtgtgccctgcttttcaagagcggcagccataacatgaatgccaaattcgtgggaagaagcccgcaggtcatcgcggaagcggcgaagataaccattccggcaggaacgagagttctgatcggagagcagggcggcgttggtgagggatacccattatcctatgaaaaactgacaaccgtgcttgccttctatacggtaagagactggcaggaagcctgtgaactcagcatccgcctgcttcagaacggtatcggccacaccatgagcatccacacggaagacagggagatggtgagaagatttgcggcgaagccggcttcccgtattctggtcaacaccggaggaagcatgggaggtaccggaatcagcacgggattggcaacctcctttaccttaggctgcggaacgtgcggcggaagctctgtttctgaaaatgtcagcccgaaacatttaattaatattaaaaaagttgcgttcggtgtgaaaaattgtgctacactggtgcaggaagataaaacgttccgtcatccggaactggcttcacagtcctgctgtcagggaacctgcggtacggcttccagcccggctgatttcgttgcctcctttgaggaaaaacactctgcctccggtacggcgaaggctgacactgcggtttccgcagactgcggcagcgataagctggcagcactcgtaagagaactggttatcgccatgaagaaccagtaaagcggcagaaggaggagacccatggatcagtatgaggcaatgatcaagcttcttttggaagcggtaaaaaatgaggacggcacagcggcgggtaacgcttccgcgaacaccccggcaaatgcggtgccggtcggcgtatccaaccggcacgtacatttatcccaggccgatttagataccctgttcggccgcggatacgaattgacgaagacgaaagacttatcccagccgggccagtttgcctgcaaagagaccgtaacggtctgcggaccgaagggggccattgaaaaggtaagaattctgggacctgtaaggagccggacacaggtggagattctcgcaggcgactgctttaaactgggcgccaaggcggaaccgaggctgtccggtgatctggacggtacgccgggaatcactcttgtgggaccgaagggatccgtacagacgaaggaaggtctgatggtggcgcagcgccatatccatatgcatccggatgacgcggccaggtttggcgttcatgacggccagtctgtttctattgagacagatggattacgcggaggcgtttaccgcaatgtgttaatccgtgtaacgccggaatccgcactggagtgtcatgtggatacagaggaagccaacgcgatgggaatcggttgttccgcggctgtcactctggtaaagtaaatcgtctgtttataaaaagtatagcatttaaaattaaaataaaattcaggaggatttcacaatgaaatacgatgcattaggaatgattgaaacaaaaggtttagttggatccatcgaggctgcagatgccatggttaaggctgcaaatgttacattaatcggcaaggaattcgtaggcggcggtctcgttactgtcatggtaagaggcgatgtcggtgcagtaaaggcagcgactgacgcaggcgcggcagcagctcagagagtaggcgagcttgtatccgttcatgtgattccgcgtcctcacgcagaggtagagaccattcttccggcagctgcaagagaagagtaatcagtcagggagtgctctcgtttcggagggtgctccttaaccaataaggagggcttacaagaatgaatgaaggtgcaggcgcagcagctgttgctgcgaagaaaaaattatctgctcagttttttaagaagggtgtatttgttgcaatcatgtccggtatctgttacgggctgtattccgcgtttatgacactgggaatgacaaaggggatatgggcggactggtatggtcctaatacggcggctttgtctgcttttgtcattacgtatctgctcggctcactgggaagcgcgatcaacgatacgtgcagcgcggtatgggccctgctgattgccggagcaaagggaaagctgggcgactttttccgctgtttaaagacgaaaccaggctggatcatgatcgctgccgctctggtgggcggccccatctccagtgcggcctatgtggttggacttcagatggctggttccatcgttattccgatttcggctctctgccctgcaatcggtgcaatcttaggaagagtgctctacaagcaggaactgaataagcgcatggttgccggtatcgggatctgcgttctttccagctttatgatcggaagcaccagtctgggcggcgatgctccggagggccggcttctgggaatctgtatcgcatttatcgcggctctgggctggggaatagaaggatgcgtagccggttatggtacgaccctgatcgactatgagatcggtattaccattcgccagtgtacctccggactttccaacctgtttattctggttccgatttttggcatcattgccggcaacatcggcattgcccctcatttaacggttcaggcatttaccagcggtccagccatgatctttttcgtgatcagcggattcttcgccctgtttgcatacagtctgtggtataaaggaaacagcatgtgcggtgcggctctcggtatggcgtgtaacggagcgttttccttctggggaccgttcttctgctggattatcctcggcgtcatctgcggaatcgacggctggtcacttccgccgatcgtctgggcggcagcgattctgatgatattcggtatccttatgatcgccatgaatccgctggatttatttaagaaaaaggaggactaggcagatgaaaccactgagttacgcgattatcaaacactttacggaggtcccagaggcctgtgcggaagatgtaatcgacgccttaaagggagattacggtaaattcaggggattgacccttaagtctgtgatcgagaccctgatgacggacgaggccaacggtctccttgaggaatccagatttgaactggatgaagttggaaatttaaggatttactaccgggcgaatgaggagcagaaggcgaccatcaaccggtatatcaaagactgacggcgggatacggtataaccgctgaacagccatcgattggaggcgggcctggcccttccagtcgatggctgttttgtgtaataggaaggtgctccgcaccctttactcctctgtgtatggaatttactgcagtgtacgaatccactacaatggtagaaactgcgctttccgctggcggaacaccgtataatacgagaacccgcattccttcagcagttcccttgtccgctcgaaatcagcccctaaatcttcaggtatatgggcgtccgagccgatcgtcaggatttctccgcctaactcccggtagcgtttcagcacatctgccgccgggttgggctggctgatgcccttccgcagtccggccgtgttgcattcaatccccttgccgtgttcgatgacagccttaagaatcctgtcgaggatgtccctgtaagcctcatagctgtagaaggcggccttgttgggaccgtatcggatgatgtagtcgatgtggcccgccacgtcgtaatcgtccaaatggctgacattatccagcgtagtctcaaaatactggaggtaggcattggcctcccctctctcctcgaaaaactccgggtaggcgggatcctttctgtctataaaatgggtggaaccgatgacgaaatcaaagggatatctgcgggtcagttccttaaaatactcctttaaatggacctgcagtcccagttcgattccgatcctcacatcaatccggtctttatattcttcctgaagcctggtgagagaactcatgtaggggtccaaatccaggttgaagtcgatgatggattccacgtcatagtcgtggtggtccgtgatgcacagcgaatccattcccagttgtatggcacgctcgatctgcgccctggggggcgtcgtggagtcgccggaaaaatccgtgtgcagatggtaatctggcagcatgactgtctcctctctctctgaatgaaagctaaaaccattataatcaatatcgttgggaaaagcaacgcaggattcgtcaggtttacacactttttaccaaaagtttacagaattcataaaaagcgttgaaaagatattccggtctatgatatcattagagatgcgcgcggcggagggaatccatgcgggtatgacgccggcgcttaaaaaagaaaatgaatgcagttgaaaaaggggttacaaggaggtaactatgtctgtcaatgacatatcaagtctgttcagctttatcggtggactggggatgttcctgtatggcatgaacatcatggccgacggtatgcagaagaccgccggaagtaagatgagccagtttttgggaatgttaacgaacaatcgtctgatggcggtccttctgggcgcgctgatcacggcaattattcagagcagcggcgctacgacggttatggtagtcggttttgtaagtgccggggtcctgaatctgacgcaggcggtaggcgtgatcatgggtgccaatatcggtacgacgattacggcctggattgtatctatgaaccagctgggagatgcgtttgccgtattccagccggcattttttgctccgctgttgatcgggatcggagcgattttcatgttatttggtaaaaaacagaggatgaaaacggcgggagagattctggtcggccttggtcttctgttcattggtcttgattttatgtcgagttccatatcgccatacactgacgcgcctgttttctctgaggcattccgcctgctgggaagcaatccattgctgggaatgatcatcggtgctctggttacggctcttcttcagagctcctccgcctcagtcggtatcttacagactctggcgatgaacggtgtggtaacgacgaacgcggcgattttcatcacgctgggccagaatatcggttcctgtgtgaccgccatgatatccagtatcggcgggtccagaaccgcaaagagagcggccgtcatccacctgacatttaatgtgatgggcgccgtgatattcggagtgatttcgtttatcctgttttcccttcatccggtgcttgcggcccataacattacatctgtgcagatatcgattttccatacgatctttaacctgacgaacacggcgctgctgttcccgtttgccaatcagctggtgaagctctccggagtcttcgttccggaggataagaaggaaccggccgtcactgacgaagagtccgagacgatgaagcatctggatgagagaatcttcgaatctcccgcatttgccgtggagacggcagccatggaagtggttcatatgggacagatcaccatggagaatgtcagacgggccatggacgcggttctgactaagaatgcaaatgaagtcgaagacgtgtataaaacggagcagaccatcaataatatggagaagatgctgactgaatatctcgtcaaggtcaacaacctgtcgctgacggaaagacagaagctggttgtgaatgacttgttctacagcatcaatgacattgagcgtgtgggagaccacgcagaaaacctggccgagcaggcagaatacatggttcagcataatatcagcttttcagaaacaggagagtcggaccttcatgttatttgtgagaccgcttttaactcgttcaaacactccatcaacgcccggcagaagggggacatggacgatgtcagaaaggtaagccagtacgaggatgaggtggatacgctggaggaggagctgagagagaagcacatcgagcggctgtctgccggtaaatgtgacccttcggcaggggtggtatttctggatcttatcagcaatctggaacgtatttctgatcacgcatacaatcttgccggttacgtgaaggacgagatgtagaaaatgttaaaaaagtaacaaaatccaaaaaatgaaaaaaaggacttgctatttaatggattattaggtagaataaagggtagttgattttattttaacaaaatcacaagaaatccactcttcattacagattgtggatatgtgaattaaaaggtacaatcaaattaattttattcttaggaggaattgaattatggcagtaaaagtagcgattaacggttttggtcgtatcggtcgtcttgcattcagacagatgtttggtgcagaaggttatgatgtagtagctatcaacgatttaacagatccgaagatgttagctcatttattaaaatatgacaccgctcagggtggatacacaggacgcatcggtgaaggccttcacacagtagaagctggagaggactccattactgtagacggcaagaccatcaagatttacgcagaaaaagatgctgctaatcttccttggggagaaattggcgtagatgtagtattagagtgtacaggcttctactgctctaaagataaatctcaggcacacatcaatgcaggcgctaagaaagttgttatctccgcaccagcaggcagcgatctgccaaccatcgtttacagcgtaaacgagaaggaattaactgcagatgataccatcatctccgcagcttcctgtacaacaaactgcttagctcctatggctaaggctctgaacgattacgctccgatccagtccggtatcatgagcacaatccacgcttacacaggcgatcagatgatccttgacggaccgcacagaaaaggcgatttaagaagagcaagagctggcgctgccaacatcgttccgaactccacaggcgctgcaaaagcaatcggccttgttattccggaattaaacggcaagttaatcggttccgctcagcgtgttccggttccgacaggttccacaacaatcttagttgctgtagttaagggcaaagacgttacaaaagaaggcatcaacgcagctatgaaggcagcagcttccgagtccttcggctacgaagaagatccgatcgtttcttctgacgttatcggcatgagattcggttctctgttcgatgctactcagaccatggtttccagccttggtgatgacttatatcaggtacaggttgtttcctggtatgacaacgagaactcctatacaagccagatggttcgcacaattaagtacttcgctgaattaggctaattattaaagatccatggagggtccggtcgtttggaccggacccttttatcgttcaaaggaaggggcgctccggcgtgtcctttctcttataaaacaggttcgtatcctgtatccataaccatttcgttatggatacagcgtcaagtcaaaaccccgccgcaggcaacggggcatccaatttgcaacgccgtgaacggcggggtttttaaccctcgcggcagtcgtcaaatggtcccgcaagcgtgcccatctggctcgttgcccgcgggaataagcgaaaatatggaaaggagcatgaaattatgcttaacaagaaaacagttgatgatttaaccggattacagggaaagaaagtgctcgtaagatgtgacttcaacgttccgttaaaggaaggcgtgattcagaactacaaccgtatcgacggtgcgattccaaccattaagaaattacttgatcagggtgcaaaagtgatcctttgctctcatttaggaaagccgaagggagagccgcttccagagctgtccttagctccggtagctccggcactgagcgagagacttggcgtagaagtaaaattcgtggatgatccgaaggtaactggaccggagacacagaaggttgctgccgaattaaaggatggcgaagttttattacttcagaatacccgttacagaatcgaagagacaaagtacggaaaagatgagaatgcggaaagctatgcgaaagaactggctgatctctgcgacggcatctttgtaaacgacgcgttcggtacggcccacagagctcactgctccaacgtaggcgttacaaaatacaccaataccaatgtagttggatacttaatggaaaaagaaatcaagttcttaggacaggccgttgagaatccggttcgtccgttcgttgccatcttgggcggagcgaaggtttccgataagattaacgtaatcaacaacctgcttgacaaggtagataccctgatcatcggcggcggtatggcttatacatttgagaaggcacagggcgaggagatcggcaattccttatgtgaggaagacaagctggattacgctctggagatgatcaagaaggccgaagaaaaaggcgtgaagttattacttccggttgaccatgtagaaggtaaggaattctccaacgatacagaacgcaaggtcgttgatgttatcgatgccggctggtcaggattcgatatcggaccgaagaccatcgctctttacaaggctgctctggaaggtgctaagactgttgtttggaacggaccgatgggcgtatttgaattctccaactttgcggaaggtactctggaagtatgccgcgccgttgctgatttacaggacgcaacaaccgtaatcggcggcggagattccgtaaacgctgtgaagagacttggtttcgctgacaagatgactcatatctccacaggcggcggtgcatccttagagttcctggaaggcaaagagctgccaggcgtagctgctgcagataataaataagtaagtaagaggagaataagataaaatggcaaggaaaaaaattattgctggtaactggaagatgaacatgacaccaacagaggctgtagagctggttaataccttaaagccgctggttgttaatgaggatgtagatgtagtattctgtgtaccggccattgatatcattccggttatggaagcagcaaagggaaccaacatctgcgttggtgccgagaatatgtactatgaggacaagggcgcctacaccggcgagatttcccctgccatgttagtagatgctggcgttaaatacgtagtaatcggccattctgagagaagagagtacttcgctgagagtgacgagactgtaaataaaaaggtcttaaaggcattcgaatacggcattacaccgatcgtatgctgcggagagtccttaactcagagagagcagggaatcaccatcgactggatccgtcagcagatcaagatcgccttcttaaacgtaccggcagacaaggctgcagaagctgttatcgcttatgagccgatctgggcaatcggtaccggcaaggtcgctacgactgagcaggctcaggaagtatgcggagcgatccgtgcatgcatcgctgagatctatgacgaagccacagcagaagcgatccgtatccagtacggcggttctgtatccgctggaagcgcaccggaactgttcgcacagccggacatcgacggcggcttagtaggcggagcttccctgaagccagacttcggaaagatcgtttgctataacaaataagtaatgaataatacaggattatgaagtgtcctgtaatgaaaaaaggtggggacagtcgcaaacgcggcttctctgcctttttattgttctgtatacagccggtatttcgcgaagcgtactgccggtcgcagcgtgtgcagtaactttttattccgctgaaaagcccggttatgcgcatacggttgacaagtgatgagaaaaagtaaataatagtaatgaatataccgatgtcagggtgcgcagaatgggtaaaggaggaagagttatggatacaaaagagccgggactgatgcagaggagtattgagatcgacatggagcaaatccggaaggaactgagtgaacaggagctgcttccgggagcatactgccaggaatacgagatatttaaagtgatataccggtttgtggcgcggaggctgaagcgcacgaatgagagcgcctatatcatcctgctgaccctgacggaccggaagggagaactgccctgtctcgagagcagaaacggacagatggagattttgagggaactgatccagtattcgatccgctgcggggatgtttatacgaaatacagcagctgtcagtttctcattatggtgacagacttatcagaggcggatgccgatatggttgcgaagagaattgcagatgcattttatcagagactgggcgggggagcggaccaggtgctgctgcaccactgctatcccatgaaagccgtggaactgcaaccttaaaccaggggttatgataaaaatttgtcattcagcagttgcaagatatccgcaaatcatgtagaatatagagttgtgagaagataattaccattatatagaaaaaacaagataaggagattaagttatgagcaagaaacctgttgtacttatgatacttgatggatatggactgaatgataactgtgaccataacgcagtctgcgaaggcagaacaccgattatggaccagctgatgagccagtgcccgtttgtaaagggcaacgccagcggccttgccgtaggacttccggatggccagatgggaaattccgaggttggtcacttaaacatgggtgccggccgtatcgtttatcaggaactgaccagaattacaaaatcgatccaggacggagattttttcgatgttcctgaatttttacaggctgtagagaactgtaagaagaatgattctgcccttcatttatggggacttgtctctgacggaggcgttcacagccacaatacccatatctacggactcctggaacttgccaggagaaatggcctcgacaaggtttacgtacactgcttcttagacggccgtgacacaccgccggcttccggcaagggctacgtggaagcgctggaagcgaagatgaaggaaatcggagtgggcaaagtagcctctgtgatgggccgttattatgcgatggaccgtgacaaccgctgggatcgtgtggagcgcgcttacaacgctctgaccaggggagaaggcggtactgctgccagcgctacggcaggaattcaggcttcttatgacgcggaagtgaatgacgagtttgtggagccgtttgtcgtagtcgaggatggaaaaccggttgctaccgtaaaagataacgattccgttattttcttcaatttccgtcctgaccgtgcaagagagatcacgagagcgttctgtgatgacgatttcaagggatttgccagagacagacgcctgaacttaacgtatgtatgctttaccgattatgatgacaccattgcaaataagctggttgcatttaagaaggaagccattgcgaatacctttggccagttccttgcagaccacgacatgacccaggccagaatcgccgagacagagaagtatgctcatgtgacattcttctttaacggcggtgttgaggagccgaataagggcgaggacagaattctggttccgtctccaaaggtggctacctatgaccttcagcctgagatgagcgccccggctgtttgtgacaagctggtggaagcgatcaaatccggaaaatacgacgttgtcatcatcaacttcgcgaacccggatatggttggccatacgggaattgaggatgctgcgatcaaggcgatcgagacagtagacgcctgtgtgggaagagccgtagacgcagttaaggagatggacggcgtactgttcatctgcgccgatcacggaaatgcagagcagctggtagattacgagacaggaacaccgttcaccgctcataccacaaatccggttccgttcattcttgtgaacgcagatccgtcctataagctgcgcgaaggcggctgcctggcagatatcgctccgacattaattgaattaatgggcatggaacagccgaaagagatgactggaaagtcattattagtgaagtaagatacgggaaatatcctgtaaaaacgacaaaaatataaaagaaaagtcatgttataatctcagacataaaaaaatagttatgaaaagtcgaaaaaaggccgcatatttgaaccttaggaaccgcagcgatcaccggcggggaagaggggacagagtgacggcctttttcctgcctccgtgggaacgaatggtggttgttcgtctggctggcggatgatataatatgggaagaaaataaaagaaaggggaattaccatgttggatcaaaaagttgcagaacttattaatgtgcaggtgaataaggaattttactcggcgtatctgtatctcgattttgccaattactaccgcgaggcggagctgaatggatttgcaaactggtatcaggtgcaggcacaggaggagagagaccatgccatgctgtttatccagtatctgcagaataacagcggcaaagtgactcttgaggccattgacaagcccgataaaaagtttgaggactacgtcggaccgctgaaggcagggctggagcatgaggtctatgtgaccggacttatccatgcgatctatgatgcggcatactctgtaaaggatttccgaaccatgcagtttctcgactggtttgtgaaggagcagggcgaggaagagaagaatgcagataatctggtgaagcgtttcgagctctttggccatgatccgaaggggttatacatgctggattctgagatggcggcccgcgtatacaccgctccgtccctggtgctgtaatgggaaagaatgaatatctctgcccgtgcctgaagatcacgaaaaaggatatcaaggaggcgatcgcggacggcgcggattcctttaagaaagtgaaaaagaagacgggagcttccctgaaatgcggccattgtgagtgtcgggtgaagaagtatgcgaaaaagcagttgaagaagcacgcttgacaagcgcagcaaagaaatctatactaaatgtgcaagggtttctaaacaactcccttagcactaaaggaaagatgaatatgagaaaaccacttattattcaaacagattttggcactgcggacggggctgtctgcgcgatgtatggagtatcctatggggtagacccggaacttcggattacggacttgacacacgatattccccagtatgatatctgggaagcatcctaccggctgatacagacggtgaactattggccggagggttcggtatttgtcagcgttgtggatccgggagtgggatcgacgagacgaagtattgtggcgaagaccaccacgggacagtacatagtgacacctgacaatggaacactgacccatgtgaagcggatgtgcggaatcacggaagcgcgtatcatcgatgagaatgtgaaccgcctgccgggatcgggagagagctatacgttccatggccgtgatatttacgcttataccggggcgaggctggctgccggtgtcatcaccttcgagggagtaggcccttccgtggaagcggaaagcgtcatcgagcttcctgttgtggaagcggcttataacggagagcgtgtgagcggtaccatcgatgtgctcgacgtcagattcggaagcctgtggaccaatatctccagagacctgtttttgaagattggtgtaaaacacggacagcgtgtggaaatcagtattgagaatgagacgagaaccctgtacaagaatattctggtttatgcaaagagctttgccgacgtttatgtaggcgaaccgctcatctatgtgaacagcctggactgcatggcggtagccatcaatcagggcagctttgcaaaggcctataacattggaacagggaataagtggcagattacgatgcgtaaggcgcctaagattatatacgaagactaaacactttatctgatttaacagataaaggatgaaaaagtgaatagacattgaagacggctgtcccgccgctccggaagaaggagcgggcgggacagccgtctttatcgcgctaaggaagtatggccgctgaagcgaccgcgctccggcgcgagagtccggcgggcgggactctttgctcttgcttttttgtcttatgatcgtccggtcagatggtaatcgcgtattttatgacatgatcggcctgcttttcaaatatctcgtaagcctccaggatatgggctaaatccgtccggtgtgtgatgaggcagccggtatccagctttccttcctcaatcagcttcaaaatttcactgcaggaattggcatcgacgcctcctgtcttgaaaatcagatttttcccatacatagaaggcagaggaagtacctgcggttcctcatagagtgcgacgatgcagacaaccgcgttgggacgggcgatctgccaggccatctggaaggtgtccttccctccggccacttcgagaacggagtcggcgccccggccggatgtgagttccagcactctttccaggacattttcattgcgcgggtttaaggtgtaatcggcaagaccgcggcgtttggcaagctccaggcgctcctgggaggtatcgatggcgatcagcttccccggatgatagaggcgggcacacatcatggtgcataagccggtagggccggctccgatgacggccgccgtgccgccctccccgatctccgcaagccccgcaccccagtagccggtggataggatgtcccccgtaaaaagggcggcttcatcggtcacagaatcgggaatcggcgtgaggccgttgtccgcaaatggaatgcggacgtactccgactgacctccgtcgatccggcagccgagagcccagccgccatgctcatcagtacagttattgacatagccgcgctggcagtaaaagcactccccgcagaaggtctccacattgacggcaaccctgtcgccgggttttacccgtgtcacctcacttccggcctcttccacgatccccacaaattcatggcccagtatggtgcccggaacagccctgggaactgcgccgtgcaggatatggatatcgctggagcatatggtggtgagcgtaactctcacgacggcatccctgggggtcatgatatgagggattggccgttcctctaaacgcaggattccattgccttcgtagacgacggccttcatggtttccttacggggaaggttttgtgatgtatggttctgtgatacctgattttgtgacataagcttctcctctccatactttaaaagcggtaaaaatacctcttactatactctgtataatagtctagtcaatggcctcccaattgtcaatgcgcatgcctcgaaaaatatccggaagtgtaacagttcagtctctgctgcgaactgttatccgaaagcatatccgaaagactgaacaaaaagtaaatgattttacctgtaaactttgtagaaatgtgttgacagaaggggatctctgtactaaacttaacttgttgaacaagttggacgggaggtgcctatggttaagagatgtaccggggaagatgagagccggctgctggattttttgcagaatgatgcggtctatcacacatttctgctggcagatatcggcaattacggattcgatcaggagtttcagaccgtatacgcggggctggaagaagaccggattactcatgtttatctgaagttttacgggaacttaattgtggcaggtgaggcagggaacatcgacggggagtttttaagaacactcaccgaagaatggaagccggatgtgatcatgggaaaggcggagctgacgaaagcggtcggcagatggcttcccggatatgagctggcggagaagaacctctatctcctggaggacagtgcgcacctcatcggcgaggccggactgccggagggcgtgaccatgaaaaagggcatgccgggagacgaggataagattcatgcatttctcatgacgattccggagatacgcgcgctttatgcttcaaaagagatgatcgcggaccggttaaagagcggagacgggacccacctctatctggagcggaacggggaaattatcgcccatgtgaacagcgcagcgaagagcccgtttaccgtcatgttaggcggcgcagctgtgaaggaaaaggaacggggaaagaacttagaggccctgctggtcagccggataagccgcgatattctggcggaggggaagaaaccgtgtctcttctgcgacagaggggaagaacataatctattcgtgcagatcggctttcagaaggccggaatctggggaacgctgacccctaagaagccggaagagggaaagagccggctgccatcctacataccggtttataaccggctgtttcaggatttaatggatggcgtctatgagaaggacagccttcttcccagtgaaaatgtgctggcggcggcctataaggtgagccggaacacgctgaggcaggcgctgaccattctgacacaggacggatttatctataaacggcagggaaagggaaccttcgtatcctacgactgccgcagaaatgaaaagaagaacctgtataattttttgagagagtgtgccaaggaaccggtgagccgggtgactatggattataatatcggacttccgacgaatattgcaaaacagaagttaaagcttaaggacggcgacgaagtcctggcgagcaataacgtatactggggcgaagaaggtcccatcggccagtcctttctgcagattcccatggaggtgatcatggggagcggcatagatgaaaaggaacccgacgaggaacagcttcttcattttatggacagtttgatttatcagaaggcggtgaaagcccacatgacaattcaggtggtggccgccgatgaacaggtgatctcctatatggatataccggagggaactgtgcttcttcatatggaacagattttatacgggccggattatacacccgccgcccggattaaatattatttcattcctgacaaatatcaggttgactgtcagctgcaggcgtaaccgccaaatgctcataactaggaggcatatatggatacgaataagaaaccaattattcagttcaattcattccagtttcactatttcagccaggcggaaccgacccttcatgatatcaatttaacgatctatgagggggaaaaggttctcatcgtcggccccagcggaagcggtaagagcaccctgggaaactgtttaaacggtctgatcccttttgcctataagggggagattgaaggaagccttaaaatcaacggcagggagacgagggagatgaatatcttcgagctgtcgaaaatggtgggcaccgtgcttcaggacgcggatggccagttcatcggactgacggtgggcgaggacatcgcgtttgcactggaaaacgactgtgtggaccagggtaagatgaaggaagccgtccagaaggtggcggacatggtggacatgggaaagcttttgaaatcttctcctttcgagctgtccgggggacagaagcagagagtatccttcgcaggcgtcatggttgatgatgtggatattctgctctttgacgagccgctggccaatttagacccggccacgggaaagacggccatcgatctgatcgatcacgtgtggaaggaactgggaaagacggttgtgattatcgagcaccgtctggaggatgtgctttaccgcgatgtggaccggatcgtggtggtaaatgatggccggattgcagcagacatgtcgccggacgatctgatcgcggcggacatccttccgaaaatgggaatccgggagcccctctatgccactgcactgaagtacgcgggagtcagggtgacgccggatatgcgccctggccgtatggagacgctgcggatcgacatggtaaaggacgcggtgcagaaatgggctctgagccgtgtgccggaccgggaagttaataacaggcccgatattctggcggcggaacatttaagcttccagtatacgaagaaacggagaattctgaaggacatcaatttccacatcagagaaggggagatggtcagcatcgtgggcaccaacggcgccggcaagagcaccctggccaaggtaatctgcggatttgtcacggaggacgagggacgtcttctgtacgagggcgaagatttgaaggggaagacgatcaaggagcgttcccagatgatcggtttcgtgatgcagaatcccaatcagatgatctgtaagcccatgatttacgatgaagtggcgcttgggctgagaattcggggggtagatgaggcggagacggaaaaacgtgtggagaaagcgctgaaaatctgcggactggctccatttaagaagtggcctatctccgcgctgagctttggccagaagaagcgtgttaccattgcctctgcgctggttctggatccgaagatcctgattctggatgagcccacggcgggccaggatttccaccactatacggagatcatggaatttttaaagagcctgaacagtgagggggtcaccattatcatgattacccacgacatgcatctgatgctggagtatacgcctcacgccattgtgatctccgacggacagaagatcggggatgcgacctcggcggagatactgaccaatgaggcgataacggagcaggcgaacttaaagatcacctccctctatgagctggccgtggcatgcggggtggagaatccggagggcttcgttcagaacttcatcgattacgaaagggggcttcgtcacgcatgaaaagcaaattgttcgactacatagaccgggataatttaatctttaatttatcggggcttacgaagctggtatgcttcatcggtttgaccttcgcggtcatgttttcctacgatatccgctacatcctgtttgtaatggtgctgtccgtcatcttcttcgctatgtcgggcctgcagtttaaacagatcaagctgatggcaatttacgttgtcgtatttcttgctatcaactttgtgctgacctatatcttcagtccgcagtacggaacggaaatttacggaacgacccacgagctgtttcggttcaacagccgctatacggtgacggaagagcagctgctctatcaggtgacgaaggtggccaaatacgcctccgtggtacctctgggaatgattttcttactgacgaccaacccaagtgagtttgcggcgtccatcaaccgtgtgggctgtaattacaaggcggcctacgcgctgtctttgacgcttcggtattttccggatactatccggaattaccaggatatcgcgctggcacagcagagcagaggactggatttatccaggaaggaaaagctcggaacgagggtgaaaaacgtgatgaatatctgtgtgcccctgatcttttccacgctggaccggattgagctgatcagcaatgccatggatttacgcggcttcggaaagaagaaaaatcggacatggtacgtggcaaagccattaaagactgtggactggtgcgcgatggcggcagcattagcgattttcctgggatctctggctatgacattttttgtcaacggaggttccagattctataacccattcatttaaacaatcataaaggagaaaaactatgaaaccaattttagtatttcagacagattttacttacaaagaaggtgcagtcagctccatgtacggcgtggtgaagtgtgtggaccgtgagctggagattatggacggcacccatgagcttccgcagtatgacacctggagcgccagctaccgtttatatcagagccttcagttctggccggaaggaaccgtttacgtgtctgtcgtggatcctggagtaggaacgaagcgccgcgcctgtgtggcaaagacggttgacggatactatatcgtaacgccggataatggttctctgacacatgtaaagaagatgatcggcatcgaagcggtgcgtgagatcgacgagacagtaaaccgtctgagaggaaaaggcacggaaggcgttgccatcttccacggccgtgatttattcggctatacagcagctcgtctggccagcggaatcatcgattttgagggcgtaggaccggagtacccggtggaggagatcgtggagcacccgattctggaaccggagattacagagggaaaggcctgcggcgtattcgaaatcaatgatcctaactttggaaacttatggacgaacatcagactggaagactttaaccgcgcgggatttgcttacggtgactatgtcaatgtaacagtaaagcatgacggagaggtggctttccagcagaaggtattattccatcagagcttcggtttcgctgaaaagggcgatccgatgatttataacaatgagcttatgaaggtgtctctggccgtcagccagggaagcttctgtgacaagtataatctgggatacgggccagaatggacggttgagtttacaaagtagaatttacttgacaaattatgggaatttgagtagtcttaactcgtaatctaccaaccaaaggagggtaatcatgaaaaagttatttgagttcaaaacaaagaccatcgttgcaaccggacttggcgcggctttattcaccctgttatttatgtacgtgaagattccgaccggaattccggaaaccgacattcagaccgcatacggcatcggcgcgtttttcgccgctctgttcggaccgatcgcgggcggactgattgcattcatcggacatgcgctgtctgacggtattcagtatgggtctatatggtggagctgggtagtggccagcggcatttcctgcttcattatcggtctcgtatatccgaagcttcatgtggaagacggtgaatttggaaagaaggatatcgttcttttcaacatttaccagattatcggtaactttgttgcgtgggttatcgtagcaccgcttctggatgtcgtagtctatgcagagccggcaaacctggtcgtgacacagggcgtcgtagctgctatcagcaatgcgatttctgcaggcgtcatcggttcaatcctgctggtactctacagcaagacacgttccaagaagggcagcctgacaaaggaataaatcagtatataagaaccgccgccggcaggcaagacctgcaggcggcggttccttcgttattcgcgcattactcgtcaaacagctttgaatagatctcttcacacagcgcatccacgtaagcctggtcgggaaggtccttcgaggtaatgaggaggtcagaaatcagctcgaaccgcttcagattcctctcatcctcgcccaaatcagaaaaatcggcatcgaggcgcccgtcaatatcttccctgcggtaggcagagaggaaccaggagatcagctcctccgtctgtttttcttcttcctcaatctcactggccatgcccttggcggagcggaatgtcaggaaggcgatgatcagacagccgatccccataacggtcagcgtaccctgaatcaggtacttggaaaaacccgccatgggcatgtcgaaaatgcctgcccagcataagacggcaaagacggtgatggctcctccaaccagtaaaaatgcggaggcgctggacttgcggtcttcgtatttctgagatttcttcacgtaggcagcgggcggacgcaccggcttttccgccttcggcatctccccggattcctcgcccgaggcctcgctgtccatgtcttcctgcatcagggcgtccggctcctttgccagcgccgccttctgcatggcgagggcttcctccttcgattcaaacaggggaccgccgcagtcggaacagacggtaactcctttgataaattccatgtcacatttaggacagtatggcatgatgttctcctttgcatatggtaatataggtaaattatacctctcaatcacaatttcgtctatgaagaaatgaaaatagaaaaaagtaagggcgttttatgcttccctttctgagcaaaatacgatagaatagagaaagacatattaggaagggtttcagatgagtattaggatcaggtttgcgttaaggccaaagaaccggctgaccggctaccgtgaatggacgccggatgccgcggagacgatgattaaggaactggctggagagcagggctatacatgcgagtctctatccggatgtctgctttgcaggctctgtccagagggctatatatggttccactgggataaacgggttctgcggggggagtcccagaccaacatcgtggggcccggctttcatgtggctgtcatagcatttttagagcagctggccgggcaaggaaaattaaaattaaaagttgatgacaagacgggctattactggagaagagattttctgactatgcggagaaagtatttctatcagtggtttatggatctgatgaaactggtgtccggatgggagaatgggccggaatatacattttgctggccttccagctactatataccggagaagcaggaaggaaagctgattacacatatccgccctttttcgtttatggaaattcgcggagtcgtgaattcaggactcagtatggcatttgccagggatttttttatttggaatgagattgaaaaggatgccgtttactacagaaactgcgcactggtgcttttaaatcagagctgcttttttatgccctccagcaggtgcgagacggataagcaggtcaatgacaggattattgagtgcctggaaaaggcgctggccatggattccagcctgccgtttccgttaaaagaatatctggagatatgccgcctcgcagagcatgaaccggtggatgtaagccatgcggagccgctttcgagagagcttttcgtgggctgccggagacatctcatttaccggaagctgggcaatatgaaattctgcctgccgggatctttcatgttcgacgaaaactgccgcaacggcatggatcattactacgacggcgtggaatacggcggtcatgatctctacatttacgcggtggtcttaggtacaggcggcacatccaaatttaaaaaagcatggttcgaacaggggacgccggaagaggagttcctgtttgatgtggataaaggaaagggaaaagcggtcttttatgcgcccgaagagaaggacggagagatggtttacaacatgtccgcccaggttctctacaaagaacagagaaccaatatcaacataacctgcaggaagcccggggagatggagtgggctcttgatctggtgaaaaagattacaataacggaatagaggattttatggaacagaaagagatgaaaacgggaacactcttaaaacgatttgttccctattataagaaatacacacggattatggtgtttgacctgctgtgcgcctcgctgaccacggtctgcgagctgattctgccgctgatcctgcgctatatcaccaatcagggactgaaggatctggcctcactgaccgttcagacgattgtgggcatcggtgtgctctactttgccctccggattgtggacggtctggccagcttctatatggcgtacacaggccatgtgatgggcgccgccattgagacggatatgcgtcaggatgcgtttgaacatctgcagaagctgtcggataattatttcaacaatacgaaggtgggacagatcatgtccaggatcaccagcgatttgttcgatgtgacggagttcgcccaccattgtccggaagagttttttatcgcctttttgaagaccgcggtgtcctttgtcatacttgcgggaatcaatcttcccctgacggtgatcatatttgtgtttatccccgtgatggcggtctcctgctcctacttcaacattcaggtgaagagggcattcaagaaacagcgtaaccatatcggtgagctgaacgccagaatcgaggacagcttactcggcaacaaggtggtccgcgcctttgccaacgagggtgtcgagatcgagaagttcaatcgcgataatcaggaatttttaaatatcaagcgccagacctataagtatatggcggcgttccagaataccatccgcatgtttgacggactgatgtacgtggtagtcatcgttgcgggcggcatctttatgattaaggggcttatcgatcccggcgatttagtggcctataccatgtatgtgacgacgcttctggcgacaatccgcagaattatcgaatttgcggagcagtttcagaggggaatgacgggaatcgagcgtttcacggagctgatggacgcgtcggtggatattttcgatgaggaaggggcggttcccttacgggatgtacacggaagcatcacatttgaccgtgtgtcctttgaatatccggatgatcataatccggtcctttcgaatatcgatttaaagatcaggccgggggagaaggttgccctggtggggccgtcgggcggcggaaagacgacgctgtgcaatctgatcccgcgtttttacgaccctaccgagggacggattctgctggacggacaggatattaagaatgtaacgctgcagagccttcgcggaagcgtcggcgtcgtgcagcaggatgtgtatttattctcgggtacggtttatgagaacatcgagtacggccatccgggtgcctccagggaagaaatccttgcggcggcgaagatggcgggagcccatgaattcatcatggggctgaaggacggctacgacacgtatgtgggcgagcgcggtgtgaagctttcaggcggccagaagcagcggatcagcatagcgagggtatttttaaagaatccgcccgtcctgattctggatgaggccacatctgccctggacaacgagagcgaacatctggtatcgcagtccctggaacgtctggcagcgggcaggacaacccttacgattgcacacaggctgacaaccatccggaacgcggacagaatccttgtcctgtccggcagtaatattatagaagaaggaaatcacgaggaactgattaagaagcagggaatctattaccagctgtacacctccgcaggcgaagcggagcagaattagtgcggtccagcgtatttacgccgggaggcacttgatggaaaatgaaggagaatagcagatgagagtagcgattgttacggacagtaacagcggaattacacaggagcagggaagacaggcgggaatctatgtggttccgatgccctttatgatggctggagagacgtattttgaggatatcagccttacacagaaatcattttatgagaggctggcggagggcgcggatatctccacgtcacagccgtcacccgcgtctctgatcgacttatggaacgagttgttaaaggatcacgacgctgtgattcacattcccatgtccagcggcttaagcagctcctgcgagacggcccacgcgctggccgccgacttcggcggaaaggtgctggtggtcaataaccagagaatttctgttacacagcggcagtccgttctcgaggcgaaggccatggcggatcagggaatgagcgcggaagagattaagaaggtgctggaagagacggccttcgattctaccatctacattacggtggacaccctggagtatttaaaaaagggcggccggattacgccggcagcggcactgctgggaacatttttgaagattaagccggttttgacgattcagggagaaaaaatggatgcatttgccaaggcgagaaccatgaagcaggcgaagagtatgatgattacagccattaagaaggatttggaggagcgtttttccgatccggagggcgcggctgtccatatggcggtggcccatacggataatgagacggcggctcttgaatttaaaaaggaactgatggagctgttcccgaaggccggcgatatctacgtggatcacttatccttaagcgtgtcctgccacatcggaccgggagcgctggctgtcgcctgtacgaagaagctgtctctatgagcggaacagaccgggaggtgtgcttaagatgttcttccaggtaaaaccgattaaactgaaacacaccgtaagcttaaggctggtgctgatcctgttcttcctgatcatcggtctggctcccatgctgatccagaataagatcatgctgggaacctacaggcagaaccagatcgatgcgcggattcaggatattcagaaccagtgctcgatcctgagcaataagatgacgcggggcggctacctggtgaatgaacccagggatacgctgttagacaatgagatgtccgtgaaagcggacatgttcaatggcagaattgtcatcgtcaataagaatttccggattgtttccgatacattttcgctgtctcttggcaagctgaacgtatcggaggaggtgatccgatgcttcaacggggagaacagcagcaagtataattcggacaagaattacgcggctctgacgatcccggtttactccaacagcgaggacaaggtaatcgacggtgtcatgatcgtgacggcgtccaccgaggatctgctgacgaggctgtcctccgtgtcggaaaagggaagcttcctgcacctcatgatattttccatcctggcgattctcgtcgtgcttctcgtcaagcttctgatgaacccgtttaaggagctgcagtggaagctgaaacgggtggaggaaggcaacctggatgaggaactctcctccaacgcgtatacggagacgcggcagatcacggaatcgatcagcaagacgctgaaaaaactaaaggcggtggaccagtcgagggaagaattcgtatcgaatgtatcccatgagctgaagacgcccattacctccatccgtgttctggcagattccctgatgagtatggatgacgtaccggtggagctgtatcgggaatttatgacggatatctcggacgagattgaccgggagagcaagattatcgatgaccttctgtctctggtccgcatggacaagacggcgggggccgagttaaacatcgcgcaggtgaatgtcaacggcctgctggagctgattttaaagcgactccgtcctatcgcaggaaaacgcaatgtggagctgacctttgagagcatccgcgaggtgacggcggacgtggacgaggtaaaactgtccctggctctcaacaatctggtggaaaacgccattaaatataacgtggaaggcggatgggtgcgcgtcactctcgacgcggatcacaagtttttctacgtcaaggtggcagactccggaatcggcatatcggaggaattccaggagcacatatttgaacgattttaccgcgtggacaaggcccgttccagggagaccgggggtaccggcctgggcctcgccatcacgaagaatattatcctgatgcatcagggagcgatccggcttaccagcagggaaggcgagggaaccacgtttaccgtgagaatcccgctcacctatattccatagaaacaggaggacgtaatttatgaaacgatggatatacagtctgctcctcctggtacttcttgtcgttctggcaggctgccagaggagagacgggaatgaggaacagacggagggagtgtaccagatctattatatgaattcctccatgacgaggctggaaccacaggactatacgatgccgcagatgccggcagacgggacagccacagagacggactggaagatcaccaatctgatggagcagcttaagacggtgccgcaggatttagaccgccagtcggctgtcccggataaagtgggatttgaacggtataagctggaggatacggtactctacctctattttgacaacaattacgccatgatgaatccgacgagggagatcttatgcagggccgctctcgtgcggacactgacccaggcggagggcgtggactacgtggctatctatacggcggagcagcctttgatggacagcaccggcgtgccggtgggcgccatgacaggagccgattttatcgataatatcagcaatgtcaacgcgtttgagaagacggagctgaccctgtattttgcagacagcaccggagaaaagctggtgaaagagcagcgggaggtcgtacataacgtgaccacatcactggagaagctggtggtggaacagctgatcgccgggccggacaggccgggaatcaacgcgacgcttccaaaggatacgaagctgttaaacgtatcggtcaatgaaaacgtctgttatttgaattttgacgcatcatttttaaataattcgctggatgttaaggaatatatcccagtctattccattgtgaattctctggccgccgtttcgtctgtcaataaagtgcagatcgcggtcaatggttcccaggatgtgatgttccgggattccatatccttaaaccagctgtttgaacgcaacttggattacaacgcggagaacgaagacagtccgcagtaaacaggaggaaagtatttataaaacgtccattatgtctgatagcagggggattcgtacttggagagaccgtcgttctgctttctctgacatcaggacttctgattccggcgcttctggcggcgggaacaggtgcagtatgcctgaaaaggaggagcaaaggagccgtgtggctgcctgtgttcctcctttttgtgctgctcggaatgggacgggcaggggatacgaagctgaaatgggatgcgcgggaacgggcctgcatggagatggccggcgtctattcggagctgcatggacgggtgagtgcagtggaagagtctgaaggaaaggtacagattacgcttgaggaaaatgtggtgcggccgctggtggggggcggagagggccggtccttcagcatgagccggcagattccttgtgtcctggtatcgtggaaaacggatggggcggaagatatgccggacgcccgggactttaagattggcatcgatgttactgtgagaggcaagctggagttatttgcacgcgccaggaatccgggtgagtttgattccaggagttattaccgcgggcagggggtggactgccgcatgtatggggaagaggtggagatttcaggaggagacgtctccccgcttccggagcttttgcggcaaatccgggaaaaggcgaagcataatattatgagatctgcggcggtggaagacgcgggtatcttttctgcggccgttttaggggataagaaagcgctggacagcgagattaaggatttatatcagaagaacggtatcgctcatctgctggccatcagcggccttcacttatcaattatcggaatggggggatataagctgttaagaaaagccggtttaggctataaaggagccggactggcgggagctgcttttatcttctgctacggcgcgatgaccggcgcatcgccttccgtggtgcgggccgtcgtcatgatgagcaccggtttcctggcgtcttatctgggaaggacctacgatctcctgtcggcgctgtccctggcgcttctgatgctggtatgggaaacgccggagcttttgacgcagggaggtgttcagctgtcgttcggcgctgtctttgccgtgggaggcgtgcttcctgtcattcaggattatctggggaaggaacgaaagattctgggcgcgctggcggtgagtgctgcaattcagctggtgacgctcccggtaattctgtgggatttctttcagttccctgtttacggaattttcctgaatctgctggtaattcctttgatgggaggtgtcatatgctccgggatcgggacggctctgctgggcgggatttcctgtaaggcgggtgcgctggccgcgggaaccggtcactatatactgcggttttatgaatggctctgccatgggacggaacgccttccgtatcatacgctggtgatgggaaggccggctgctgcggctgtgattctttactatatggtgctgctggtggtgctgatcgggatgaagagagtgatagggaagagagacgaagcggaaaaagagagagaagaggtatcagagagaaaagaggtaaaagagagaaaagagagagaagaggtaaatgggggaatagaaggagacgaaataattggaatggccgaaaaatcccgcccaatatggctgagaacggccctgtttttctgtatctgcgtatttctgccctgtattctgatgccacgccctgttgacgggatggagattctgtttctggatgtgggacagggggatggaattctgcttcgttccggccgcggcgccatgctgattgatggggggagtacctcggagaagaagctgggagagtaccggctggagccgggtctgaagagctgtggggtatcggtgattgagtatgcctttgtcagtcatggcgacctggaccatataagcggtgttcgctatcttctggagtcctgtgaggagatcgagatacgcaatctgcttctgccctgccagggaagggaagatgatgcgctcctaagccttgctgaactagccagggccagggggacaaaagtatcattgattgaagctggagatagcttttatatggaagggatcggcgtgacctgtctctatccgggaatttctgatctgcctgcggataagaacgaggagtccgaggtattgaaggtggactatggaaactgccatattttatttaccggagatatgagcggcgagggagaactgcggcttttgtctgccttatcggaaaaaacgggtgtgctttcggagattcagatattgaaaaccgctcaccatggttcccggttttcttccggagagacatttttagacgccctgggcgttaaatgggcggtgatttcctatgcggaagggaattcttacggccatcctcataaggaggtactggaacgtctgggtgaccgaagcgtgaaaatctatggaacggcggaaaggggagcgattacgatgaagacggatgggaaaagggtgaggtggaaggcgtttttggattgagagcggtttttgttcgttgacgcatcggaattcccttagtataatggtaccagtgacgaaaggcaggtagaaaggaaagacatcatgcagaatctcactcaggatattaaaaatcatagcttcaaaccggtgtatttgctgtacggcgatgaggcatttttaaaaaacagctataaaaaccagatgagaaccgccatatccggcgatgataccatgaattataactatttcgagggtaaggggctggatttgaacgaactcatcagtcttgcagacacaatgcctttcttctcggaaaaacgtctgattatggtcgaggacagtggattcttcaagggtgcgtcagacgagctggtcgcttatttgccccagatgccggatacgacctgcatcatttttgtggaatctgaagtggacaagcgcagccggatgttcaaaaaggtgaaggaaatcggctatgcagcggagatggccagacaggattttgcacagctttccaggtgggcaggaggaattctggccagagaggggaagaagattaccgggcgtaccatggagcttctcttaaatatgaccggagatgatatggaaaatatccggatggagctggaaaaactggtaagcttcactatggggcgcgacgtgattacggacgaggatgtggaagcgatctgtacagttcgtgtgaccaataagatctttgatatggtgacagccattgtgaaccgtcagacgaaaaaggccatggatttgtacgaagatttacttacgctcaaggaaccgccgatgagaattctgtttctgattgccaggcagtttaatcagattctgcaggtgaaggaactgatggcaaagggaatggataaaggggcaatcgcctcccgaatcaaggtaccgccgtttgtggcaggcaagatgatgccccaggccaagacatttacacgggagcagatcctttcctgtgtgactcagtgcgtggaagcggaagaagcggtgaagaccgggcggctgaatgaccggatggcggtcgaactgctgattacaagaaaattttaagacgttgagaagtctttacggcggaatgaaaaaggaagaaaaaaaggaaggaagataccgttgatggtaagcttccttcctttttctatacaaattcagatattgaattttattgcatctgaaaacatgtcatataacgctggcctgcctgttcccaatttattacatggaataaatcgtcgatatagtcggctctgagattatagtgctttaaatagtaggcgtgctcccagacatcgagattgaagacggggcacaagcccagtgggagcggagtatcctgatttttcgtggtagtaatcatgagagaaccatctgcggcgactaccagccaggcgtatccggagccgaagacggataacgcggcctccttaaacttctttaaaaaggcgtcgagacttccgtattccctgcggatggcttcggccagtgcaccggttggcatttggttcgaagcgggagccaggccggtaaagtagagcaggtggttgtaaactccgccgccgttatttcgtaccgctgtctggatctcctcaggaaggctggcaatattgtaaataagctgttccagcgtccagttatgaaaccgggaataatcagccagcgccttgttaagattgtcaacgtaagtctgaagatgacggtcgtggtgaagcttcatggtcttttcatcaatatagggttcgagtgcctgataggcgtatggcagcgggggattggtgaatggataatgataagtaagattggtcaagggtaacttccttatgcgctttttctatcatatgctggcgggaagcgtgccgtgagaagtgtttttcttttttaaagggcggaggaggagaaggataacctccgcccctggggggatgagctgcaaaatacaactcactttaataacgtatatagtttctttttgtgatgcatttttttgaaatagacaaaatgttttaaaagtagagcaagattgtgataaaatagattgaactataagataaataaggcgttataagctatttccttatgagagtgaccgttttaaccgtgggactggaccgttgctcatgccaggcgcacaagaatggaaatctggctgcttcggtccattaggcccggcttaactgcatggatctgggacggcatctgatccaggagacgaggctcccaacgaatcgcgtgatccggcattgcgacgccaaatgaagtggtgcccacgcaagagggtggacagcccggaaggctgatctggcagcatatgggggcattactggttacgaataatttaagacagggaatctcgtggtacagtggacagaataatcacgacttgtcacctttgtcctctctctgcatataataaattataatttaacatatataaaaaaggggaaataaattatgtgtaatatatgtagatgtctctgtggtaactggtgtggttgtagaaataatagctgtaataatagctgtaataattgctgcagatgcgtatgcaacaatccctgtgaaaataattgtaataacaattggaattgcaactgcggcaataacaacaataacaacaataattgctgcttcgatccatgtgccagagaaagaaaagaagcttatgaggccggatttagagacggctgtaacaatgcctcctgcaggcaggataactgtggttgctaatgatatctataaaaagggcggtccgtttgggccgccttaagtattccttgtatttgtgtttgtaacaacagttttcatgatagaatggtcttcccgcagccacacatttccttataatagtattcatatctgttgatatccgcatctagtgtacagatatcagccaacttaaataaaaaaatgccgctggctggagtcagtggccatatcttttaaaccgtttttcaagcagtatggtatctattcttacgtgcagtgttattaatatatcttatgcacttaaaaatagaacatctttgaccttcatattatcattcccttattccaacaatatatctgagtatatggaaaagtcatggaagtatatggaattatatatcctgtttcttcctattacaaatattagaaactttctataaatagtaacaaagtagcaacaaatcaaaatataataaaacaaaaaaatccccatccagtgggttaagccgaacggggaattcctttatttatcaggtttttctatgaattaagccattgcgttaacagccttagagatacgggatacttttctggaagcagtattcttatgatatactcccttagtagcagccttatcgatctcagcgattgcgcttattaaacatacctgtgcagcagccttgtcaccggcagtaatagcagcgtcaaccttcttaatcgatgttttcactctggatctgatcgctttgtttctagcagccttagtctcgttaactaaaattctttttttcgcggatttaatgttagccaaatctgtacacctccaattttaattgatatatggttattctttgttttgcatcaaagcctggacacggacagttcaatgtaaacataccttagtattttaacgaataaagcttctaatgtcaatacataattcctgattttttgcagaaaataccagagaaaagaaaaaaagtcgcagttcacgacccgtcggcacctgctgtccggtctgccccggccggtttacccgacctttcctgttccggtttcgggcacaaacacttctaaacgtgcagaatttttctaaaaaccagaggaaatccccaaactcgctgcactcaaacaggtggggatttcccctgaacgaaaaatcctgcgcgttaagaattgctaataccctgcaaagtcacagaaaaggtcgggtaaaccggccggggcagaccggacagcaggtgccgacgggtcgtgaactgttaaagaaaggtgagaaatatggaaaatacattcgaagttcggacggatcttgcagtagaggagaaggaaagctttccaggaaatggcggagaaataagtggggtatccttaagagagtggcatcgggcggacagccgcatcaagatgacggaagtgaaaatactggataagaagggcgaaaaggccatggggaaaccgatgggctcctatattacactggaggcagaccagttatccagaaaagatgaaaattatcacagagaggtgtcggaagagctggcacggcagattgggcagcttctggagggcgaagactaccgggcctccggcttccatgttctggtggtcggtctcggcaacagttctgtgacaccggactctctggggccgagagtgcttaacaatctccaggtcacgagacatttgaaggtgcagtatggggatgagttctggaatgggcgcagtatgccggtcatcagcggtattgtcccaggcgtcatggctcagaccgggatggagagcgcggaaattttaaagggtattattcatgagacgaagccaaatctgattattgcaatcgacgcgctggccgcaaggagcgtgaaacggctgggaaccaccattcagctgaccgatacgggaattcatccgggttccggcgttggcaatcaccgtcacagcttaacgagggaaagtctgggggttccggttatggcaatcggtgtgcctaccgtggtgggagcggcagctatcgtgcatgacaccgtatccgccatgattgccgccctgtctaaggggatggagacgaaaggaatgggggattttgtgggaagtatgagctctgacgagcagtatgatctgatccgggagctgctggagccggaattcggcccactttatgtgactcctccggatatcgatgagacggtaaaggaattgagctataccatttccgagggaatccatctcgcttttatgggagaggaagaggagtaaggggtaaatggtgattttcctgcatagtatataagcgagggacttttttctttccgggtcgccgtgaaagaaatgcaggaaggtgtttatgaaggagaagggcggaaggattaactggctcatcagacatatgatgcttatcaccggcctggtacttgccgtcctcctcttgatcaggggagcggcgggaaccggacgggcgttcgacagagagcggcttactgccttaataaatggccaggcggatgccgggctcgagtggatctggcgtatgaattatccggctgccggacgggcagaagaaaatgagacgaagatggttaaagcggaagaggaaagcatcagcggtcttatctgccgcttcatatttgggcagtcacctctgtaccggtatctgggcagggaagagggcggtgaaataaactacaaggaagaagatccggcatttgcagggtatctggaaagcggaaaattctatgaggaacaccagtacctgatgtatgacggcggtgaagagaccggagccggtaccatggagcaggctggcacgacggtgctggccgctaatggcgatggagccgcaggaagcagcggaaatacagggagtggcggaaacgcgggagacagcggaaatacagggagtggcggaaacacaggagacagcggaaatacaggaaatggcgaaaacacaggagtcggcgaaaacgcaggggtcgctgaaaacgcaggaatcaatggaaacgccgccgccctcccgaaaaaggatgataatatgacgtgcgctgccagcgtcctgcctctcataggcaaaacctacaggaaagagcagctggccgactacgactacatgatgaagcatttttacagtgtgcacacctcgacgacggcggggcgtgatcttatgaaggcggatgaatttctggcaaaggactttacactggagggaagtaacgacaaaccgcagattttaatttaccatacccattcccaggaggaattctccgattacgggcctgataataaggaagcaaccgtgattgggataggcaattatctgacggagcttctgacggccaagggctatcatgtgatccatgacaaatcggtctacgaccttcagaacggaaagctggaccggaataaagcgtatacatatgccctggacggggtcacgaggattcttcaggagaatccctccatcgaggtcatcctggatctgcaccgggatggggtcaatgaaagccttcacatggtcaatgaggtgaatggaaaaccgacggctcccatcatgttcttcaatggcgtcagccagactccggagggaccgatcgagtatctgcccaatccgtaccggagtgataatctggcattcagtttccagatgcagctggatgcggcggcctatttcccgggtctgaccaggaaaatttatatcaagggtctccggtataatctccatcttcgtccaaggtccgtgttaattgaggtcggcgcacagacaaatacataccaggaagcacgaaatgccatggaaccgcttgcggaagttctgaatatggtgttgcaaggaaattaaaaaaatggtatatttttaaagcaggaacatcattgccgtgtcattttgtatttgtatcatcaactgcagaaaaatggaaaagaggaaagtaaatggcaactgttgaccagagtaaaatacgcaatttttgcattatcgcccatattgatcatgggaagtcaacccttgcggacagaatcatagagaagaccggacttttgacaagccgggaaatgcaggcccaggttttagacaacatggatttggagcgggaacgcggaatcaccatcaaggcccagaccgtccgtaccgtatacaaggcggaagacggagaggaatacattttcaatatgatcgatacgccggggcatgtagattttaactatgaggtgtcccggagcctggcggcctgtgacggcgctgtgctcgtggtagattcatctcagggaatcgaggcccagacgctggccaatgtctatctggcgctggatcatgacctggacgtttttccggttctgaataagatcgatttaccgagtgcggagccggaacgtgtggtgggagagattgaggatgtgatcggaatcgaagcccacgacgctccaagggtctcggctaagacaggcgagaacatcgaggaggtcttagaggccatcgtgaagaagattcccgcacccaaggggaatccggatgcgccgctccaggctctgatctttgactctctgtacgattcctacaaaggcgtcatcgtattctgccgtatcatggaaggccgtgtgaagaagggcgtcagaatccgtatgatggctaccggagcggtggaagaggttgtggaggtcggctatttcggcgcgggccagtttatcccctgtgacgaactgagcgcgggtatggttggctacgtgacagccagtatcaagaatgtgaaggacaccgccgtgggtgatacgattacggacgcggacaatccctgtaataagccgcttccgggttataagaaagtcacctccatggtgtactgcggtatgtacccggcggatggcgccagatacaacgatttaagggacgcgctggagaagcttcagcttaatgatgcatccctgttcttcgagccggagacgtctctggcactgggcttcggcttccggtgcggttttctgggacttctgcatctcgaggttatccaggaacgtctggagagagagtataacctggacctggtaaccacggcgcccagtgttatttaccgggtctataagaagaccggtgagatgatacagctgacgaatccgtcaaacctccctgatccgtccgaaatcgaatacatggaagagccgattgtcagcgcggagatcatggtaaccactgagtttgtgggagcgatcatgaagctgtgccaggagagacgcggcgtctatctgggaatggaatatatggaagcaacccgtgcccttttaaagtacgagcttccgctcaatgagattatctatgacttctttgacgctttgaaatcacgttccagaggttacgcctccttcgattacgacttaaaggggtacgagcgttctgaactggtgaaactggatatcctggtgaataaggaagaggtggatgcgctgtccttcattgtacatgcggaatccgcttacgaccggggacgccggatgtgcgaaaagctgaaggaggagatcccgagacagctgtttgagattcctatccaggcggccgtcggaggaaagatcattgcaagagagaccgtcaaggccatgcgcaaggatgtacttgccaagtgctacggcggtgacataacccgtaagaaaaaactccttgaaaagcagaaggaaggtaaaaaacgtatgcgccagattggtaacgtagagataccacagaaggcatttatgagcgtactgaagttagatgatgaataaaaagaaattggaaatctatgtgcacattcctttctgtgcaaagaaatgcgcctattgcgatttcctgtcgtttccgggtaacatgcggatgcgccgggagtatacggacaagctgctggaagagatacgcattcagagcagctttgtacgggagtatcaggttgataccatttttctgggtgggggaacgccttctgtcctggatgtgaccgatattacagccatcatggggacgcttaaggaacactacgacatcgcgcccgatgcggagataacgatcgaggtcaatccggggacggtgaagatggaaggtctcgtcgcctaccgggaagctggaatcaaccgcgtcagcatgggacttcagtcggcggatgacacggagcttcgctatcttgggagaatccacacctacgacgaattcttaaaaagttttcagagggtacgcatggcaggatttacaaacgtcaatgtggacctgatttccgccattccgggacagactccggaatcgtggaggaatacgctgaaaaagacggctatgctgaagccggaacacatatctgcctacagtctgatcgtagaggaaggaacgccgttttacgaccgttacggcggccatgtggagatggagagctatgagatgtctccggaggaacgccgccgcttaatggcgctgccggatcttccggatgaggataccgagcgggaaatgtattacatgaccaggaactgtctggccgaacaggggtatgagcggtatgagatatccaactatgccagacccggctttgaatgccgccacaatgtgggatactggaccggaaccgagtatctgggactgggactgggggcctcctcttatttggagggatgccgtttccacaacacgtccgatttccaaagctacgtatcggcccacttcgacgacgaggcagagttttgtcaggcgctcagacaggatatggagcagctgagcgtaaagtccaagatggaagagttcatgttcctggggcttcgcctgacacggggcgtatcggtagaaggctttatcacccggtttggacagagtatacgaaacgtctatggcggtgtgatcgacaaactggagcgtgagggcctgctggaacataaaaacggctactaccatctgaccgagcgggggcttgatttgagcaactacgcgatgagcctgttcctgcttgactgatggaaataaaggatacagaaaaccgctgttaaattagaacgattcccattctaacttaacagcggtttttgtattgttcctttttattaccatacagtgtctgccctaattatttttcttactgaaccaggaacacttccgcacttctggtaccatatgccctcgtctctccgtgtgtattaaagaagatatcaacatggtttccttttactgcgccgccgcggtcctctgcggtatagatcacgccgttgatcataatcttgcttccgtaaggaatcactctcgggtcaaccgcgatcgtgtggttggcggaggcgatggctcctgtgctggtgtggcgtccccaaccctcggagcaggcggaacacgggcagtagccggtggtcttaaagacaccgagggagcggagcgttcctgcgcttccgtcagagctcatgacctgcatgtcgccgacactgtgtaccttcgggctggaaagcttcattcctgatgcgtaggcttcaacgagataggaaccgtcttcatacgattcccacggtacaatcacttcaaatccgtaattgccggttccggtgcctttcctgaccaggtcttcccggtagtcatcggcgggagccgtgtactcagcctctgtctgtcctgtcgcctgattggtgactgtgaccttgacttctaccgcggaagcgggatcggagctgttccaggcccagccccggacgctgtcgccctccacacaatccagaactccgggtgtctgccctgcgagagccgggacggcggtacctaataaaaatgtcatcataagtaaagttccgaagaacagttgatttcgtttcaatcgtttcatgtaataaatacatcctttcttttttactaactgtaacatattttaatatattataaatatatgtaacagttttgtaataaatgaggtacaagtacacattttacactattttccagatttgtcaaggatatgaataaaaaaatagagacgcccgatgtttcataaggcgtctctattcgttctgatgtgttgattgaaaggtttttcttcttatattataattcaggatctactctgcaattgcctgaaatacttcctgtttttttactccatagtccagtgcttcctggtggctggagaagtagagatccacggtgtggccgtccactccgcttccgatgtcctccaccgtataaacggtttcaccgatcatcacctttgttccaaggggaagtacggcgatgtctgctgatatggtgtggtttgcctgcggcacggtaccggaataggtgaggccgctgccgccggaacatttactgcatccacagtatccggtggtcttgaagatcccgagggactctccctttttatatcctccgaaggtttcttccaccggtttctcctcttttttcggaattccggggccgatctcctcgctggtgctttcagttttctttaaagcttctggtgccggtttgtattccagggagccggtaagaagtgttttctcatctccggttaccaggcaggcttctactttataagaggttccgcctatttcttcccagctgatcttatagtcaaatgcacggcagccgtctccataggactttcctgcctcttcgctgtagctttcttccggtactgtgatgacctttgccgctttggcggctccgtctttgtaaatatgcagttcaaccgctgccgtctcgtcggattccgcgttgtccctcagccaccctgtaatatggttctcatccacggccgtgagagcgcccttttcttcggcagccagagccgtcatggataaaaacagagtacagaggagcgtcacacacagcatcagaagaagctttcctgatttctttttcatgatttacctcgcaatattatgatttttccgtgaaatatgatagaaaaatgcgttgttatggtgtatcaattttcattatattacaaaactgttaaatgtcaaggaaataccggcaatacgtttgtaacatttgtcacagttccccgcccctgccgccctctgcatcccgttcggtcccggctggctcctggaacggcagcgaacaattgtcttacttcaataaaatgctttataatttataaagaagaagttcacagaaaattctcaaaaaattttcaatcgaatgtattgacaaatgagggaaaaaagaatatattatgaaatgaagatgttagcactcctaaacgttgagtgctaacaggaaggctcagaaaggaagtgtggcgggttgaacgataaggaccagttggacggccgtaaggttacgatcttgaaggccattattaaaacgtacttagaaaccggcgaaccggttggttccagaactatttccaagtacaccgatctgaatttgagttcagccacgatccggaatgagatgtctgatctggaggagctgggatacattgtacagccacatacgtcggccgggcggattccctccgataagggataccgtttctatgtggatcagatcatgcaggagaaagaagaagagtttactgaaatcaaggaactgatgctaaagcgtgtggaccgggtcgagcttctgctgaagcagatggcgagaatcctggcgcagaacacgaattacgcggctttgatcagcgctccccagtatcatagaaacaagctgaaattcatccagctgtccaaggttgatgatggaaagcttctggtggtcatcgttgtagagggaaatatgattaagaacaccatgatccccatcagccagcagctaagcgatgaagggcttttaaatcttaacattcttcttaataatgccttaaacgggctgaccatagaggaaatcaatctggacgtgatcagcagattaaaggagcaggccggcatacacagcgaggtggtcgaccgggttctcaacgaggttgcggaagcaatccgggcggacgacgatgatttgcagatttacaccagcggcgccacgaacattttcaagtatccggagttaagcgacggagagatggcaagccgtctgatcggtacgctggaacagaaagaactccttcaggagctggtcgatgatgtgaacagttcagaaagcagttcgggaattcaggtctatatcggcgaggaagcgccggtgcagacgatgagagactgcagtatcgtcacagcgaattacgagctgggcgagggcttgaggggaacgatcggtatcatcggtccaaagcgtatggactatgaaaaggttttgaatacgctgcggaatctcatgacgcagctggattcgatcctgaaaaaagatgaaaggtgaagggaagaacagtgagcagcgaagagacgagaatagaagaggaactggtagaagaggccatgaaggctgaagacgccggttccgttgaaaaggaaatagaaaaaggcgaaaaagaggccgcggagacagaagcgtgtgctgaggacgccgctgaggaaaaaaacggagaagaagagccggcagaagaaaagcaggcagaaccggagaaaaaaggattttttggaaagaagaaagagaagaaagatccgaaagacgccaagatagaggaactgaccgaccgtctgcagcggaatatggccgagttcgataactacagaaagagaacagaaaaagaaaaatctgccatgtttgaaatcggcgccagagacatcattgaaaagatacttccggttgtcgacaatttcgagagaggccttgcagccgttccggaggaggataagggcgctccgtttgcagaaggaatggaaaaaatatataaacagcttatgaagacgctggaggatgcaggtgtaaaaccgatcgaagcggtgggtcagccatttgacccgaatttccacaacgcagtgatgcatattgatgacgaatcccttggcgagaatacgatcgccatggaacttcagaagggttatacctaccgggataccgtggtgagacactccatggttcaggtagccaattgactgtgagcatttaacgaggtctattcgagtttagtgcgaacgtcgttcacgaatcttagcgaggttctttcgagcttagatgagctgaacattaaatgataaaattgagagtaaagacaattataggaggaaaaaactatgggcaagattattggtattgacttaggtactactaacagctgtgtggctgttatggaaggtggaaaaccggttgttattccgaacagtgagggtgtaagaacaacaccatctatcgtagcatttacaaaaaacggtgagagactggtaggtgagcctgcaaagcgtcaggcggttaccaatgcggacagaaccatctcttccattaagagacatatgggtacagactacaaggtagcgatcgacggaaagaactacacaccgcaggaaatctccgcgatgattctgcagaagttaaaagcagacgcagaggcttatctgggcgagaaggtaacagaggccgttatcacggttcctgcatacttcaacgacgcacagcgtcaggcaaccaaggacgcaggcaagattgccggccttgatgtaaagcgtattatcaacgagccgacggcagcagcgctggcatacggccttgacaatgaaaaagagcagaagatcatggtatacgatttaggcggcggtacattcgatgtttccatcatcgaaatcggcgacggcgtaatcgaagtactttccacaaacggcgatacccgtctgggcggcgatgatttcgacaaccgcatcacccagtggatggtagacgaattcaagaagacagagggcgtagacttatccggtgacaagatggctatgcagagattaaaagaagctgcagagaaggctaagaaggaattatcctcctccacaaccaccaacatcaacttaccgttcatcactgctacggcagaaggcccgaagcatctcgatatgaacttaacgagagcgaaatttgacgagctgacactcgatctgatcgagcgcacggctgttccggtacagaacgcattaagagatgccggaatcacagcttccgagcttggaaaagttctgctggtaggcggttccacccgtatgctggcagcacaggaaaaagtaaaacagctgacaggaaaagaaccgtccaagaccttaaatcctgacgagtgtgtggcgatcggcgccagcattcagggcggtaagctggcaggcgatgccggcgcaggcgatatccttcttctggacgttactccactgtccttatccatcgagaccatgggcggcgtagcgacaagactgattgagagaaacaccacaatcccgacaaagaagagccagatcttctccacagcggctgacaaccagacagcggttgatatccacgttgtacagggcgagagacagttcgcaagagacaacaagacactcggccagttccgtttagacggaattccgcctgcaagaagaggcgttccgcagatcgaggttacctttgatatcgatgccaacggtatcgtaaacgtatccgctaaggatcttggaacaggcaaggaacagcacatcaccatcacttccggctccaacatgtccgatgatgatatcgataaggctgtaaaagaagcggctgaattcgaggctcaggataagaagcgcaaggaaggcattgatgcgagaaatgacgccgactccatggtattccagacagagaaggctttacaggaagtaggcgacaagattgacgccaatgataaggctgccgtagaagctgatttaaacgctttaaaagaagccatcaacagagctccgatcgaagagatgacagatgcgcagatcgaagacatcaaggcaggcaaagagaagctgatgaacagcgctcaggcactgtttgcaaaagtatatgaggctgcccagggttctgcaggtgccggccctgatatgggcgctggtgcggataacgcaggcggcggagcttcctatcaggacagcgatgtagttgacggagactacaaagaggtgtaagatagtctggtcagttgacagggctttggaaaaagtgttgtagtgatacagcactttttccgcagttttcatatctggttgtccggcaggcatgaagggccggaaccaggtaaagcgatgagtgaaaggtagacctaagatggcagaaaagagagattattatgaagtcctcggcattcccaaagacgcagacgatgcggcgattaagaaggcctacagggcattagcaaaaaaataccatcctgatacgaaccccggcgacgctgccgcagcggagaagtttaaagaagcttccgaggcgtacagcgtgctcagtgatccagataagagacgccagtacgaccagtttggttccgctgcgtttgacggaaacggcggaccgggcggattcggcggtttcgatttttccggcgcagatatgggagatatctttggcgatatcttcggcgatatttttggcggcggacgatccagaagcggtgcccgttataatggaccatcgaggggcgccaatgtcaggaccagtgtccggatcacatttgaagatgcgattttcggatgcgaaaaagagattgagcttaattataaagaggaatgtgcgtcgtgtcacggaagcggggcgaaagcgggaacctcacccgttacctgttcgaagtgtaacggaaaaggtaagatcatgtatacccagcagtccttcttcggtcaggtacagaatgtccagacttgtccggactgcggcggaacaggccgtatcataaaagaaaaatgtccggattgttatggaaccggatatattacgaagcgtaagaagtttaaggtcacgattcctgcgggcatcgataacggacagagcgtgcgtctggccggagccggtgaacctggaaccaatggcggagagcggggcgacttactggtcgaggccgtagtatccggccatccgatcttcaaacgtcaggataccagcatattctccaccgtgccgatttcctttaccagggcggcgctgggcggtccgatccgtatcaagacggtggatggagacgtggaatacgaggtgaaggccggaacccagacagacaccaaggtccgcttaaagggcaagggcgttccgtctctgagaaacaaggcagttcgcggcgaccattatgtcacactggttgtacaggtgccggagcgtatgaatgaggctcagaaggaggcgctgcgcaggttcgatgaggcgatgggcggcgacagctccgagggcgagaagcataagaaaaaaggaatttttaaatagcagttatcgataaggccgtcatcaggcagtaatccctgatggcggccttttcatttactgaaaattcttgtaaaaatttatgaatccttacaattttatacaatacacaaaatataattggttgtatcttgtaaaaaacagtaaaaaccagtaaaatagaaatcagtaaaagaaacatatcagtttcggctttggggaaatccggaaagggtaagggatgacagaagaagagcggcaggttttagagtttgtcaggcggtttcaccaggtctgtctggaagagcaggatatggaacaggtcggtcagatgatttctgacgatattgaatggactggtgcaggaagatacaatagagtaaatggacgtgagaacatcttaaacgcctttgaggcggatcagaacggaaagaagtacgattatcagatcctgagtgcggattatgcggtatcacttctcgccggacatatttattccttttcaggaagctgttacgtcagaggaaagcgggaagttctggaggacggcgagcgtgtggtgcgcgcaacgggtatctgccggtttgaggacggcgtcggatctatgatgagacttcatcactctcttccgaaccgtgcgtgggaatccgatctgcagcgcatgacacaggaagatgtgcgggtgctgcggagtctggtcggtttgcagtcaaaggaactggaggagaaaaactctaacttggacgcgctgattcagaatatccccggcggcgttatctgctgcagggacgatgaggatctggagcttatattttacagcgacggttttttaaagatgttcggctatacaagagatgagatggagacggtccttgagaataagttcagccggatgatcgtgccggaagatttgcagagcacgcgtctggacgtgatccgtcagatgaagaacggaaacaccaaggagatcgaataccgtgtgatctgcaaggacggaagttatcttgtcattcaggataatggacagctggtcatgcgggacggccagcccgtcttttactgcattctgatcgacattacagagcgcagaaaggcggatgaggagctgaagatgagtctggaacggtgccagattatcttaaatcaggcgacagacattattttcgagtgggatattaagagcgatacactgacctgctcgccgaactggatcaaaaaattcggatatcaggcgatccgtgatcatatatcggaagaggtattgagacggggcaatttacataacgatgataaaaagatctttgtgcagatgcagaaagaagtcctcttaggatccccctacggggaaaatgagatccggatagccacaaaggatgggcgctttatctggtgcagggtgcgctacacgcttcagacggaccaggacaagcggccggcacgggccatcggactgattgcggacatcgacaaggagaagcgggaaaaggagcggctgctggagctggcggaacaggactcgctgaccggcctctacaaccggggcgcggttcagacgctgatccagcggtatgtggtgaaggcgctgccgtcggaccgctgtgcgctgatgattcttgacgtggataattttaagaaggtcaatgatatttacggccatttaagcggtgacgcgatgttaagagacattgcggacatgcttcgcaggctgtttccggaaaatgcggttctggcgagagtcggcggagatgagttcgcggtccttttgtatcatgtgagaactttgggtgaggtggaggagaaagcggacgggattctcaaaaatttccggtcgattttaaggcagcaaaaagatattatatcctgttcgatcggtatctccatcgctcccgagaacggcgataacttcgcaagcatctacaaaaacgccgatgcggcactctatcaggccaaacggcaggggaaaaacagatatgccctctatgcggaatcgctggaggatgtcatgacaccggagggacagacggacgtggccggagcggcggttatggatcagaaacttgcagaccagaacctgacaggctatgtgctggatatcctgagccgctcccacagcatggaaaaatccatcaatcagctgctggagattgtcggaagacaggtggatgtgtgccgtgtctacattttcgaggatgacgaagatggaatcaggtcctccaacacgttcgagtggtgcaaggagggggtccagcccgaaaaggagaatctgcagagcataaatatggaggagctcgatcattactacgataactttaatgaggaaggaatctttttctgccgggatgtcagtacgcttctgacgcatcagcgcatgattctggaaaatcaggggattaagtccgtgctgcagtgccggatcatggaccaggggaagccgaggggattcattggtttcgacgaatgcatgaaaaaccgttactggaccggcaatcagatccggctgcttcagaccatttccaggattctcggtatctttttaatgaagggaagggcgcaggagcggcttgacagggcaatgaacggattttccgccgcattggaggagcagagagactggttttatattctggacatggagacgtgtcagtttctctacaccagcagaaaggtgcaggaacaagatccggcggtcgtctgcggcggtgtctgttactgtgtgttcttcggggcggaccggatgtgcgagggatgtcccatgctgatgctggattccgtcaggaccagtgcgtcgagcctcgtctggaaccggaataggaaatgctacgtgcatacccgcgcccaggctgtattgtggccgggaggaagagaggcgtgcatgatcagctgccgcattgtggaaggactggaaaaacagagagaggaaccagaaaatagcttggaggaagaaaaatgaaaaaaataagaagatttgcatggacggcggtgctggcattctgcgcgatcctgtggttttccatggcggcatttgcggatgatacgcaggaggtacgggattttccgggatttaacggttccggatcgaagcaggtcggaccgatcgagggcagcgtctcctatgactgctggtacgatgacgacgacagcgatgatgacgatggcggaccgggcgcttatacgtataagaggggatggcgctacagcccgggcggctggtggtttcagaacagtgatgggagctggccgtccaacggatggaagcacatcgacggcagatggtatatgtttgacaatggcgggcacatgatgaccggatggtacaccgatggaaacggcaacaaattttacttaaatccgactgacgacggcacgctgggttccatgagaatcggatggcagatcgtcggcggaaaggcctactattttaacacgatgtctgatggtacgctgggacgtcttcttgtgaatacgacgacgccggatggctaccatgtgggtaccgacggcatcatggcacagtagccgggagggaagggcgggagcccccgtattctgaacagcctggaaacatggatgacagataagaaataacagatgagacagaaaaaggctgaacctgcttgccgcgggttcagcctttttcgtttcgattacaaactctaattgccgttagattgtaatatgtgaaaatgcgttctgtgtccggtccctcatgactcagggcgagtgtgatgtggtgtaatgcatcaaggaatttcgtttttcttgatattttttgccccttgtgatcggtatggaacagaagtgattttcatccgttcaatagattaatgcatgaggatcgtgttttattgcatctatttcaaaaaaaaataaaaaaaatttatttttctttttcgctgccatgcgttatgatggaacagacagccgtacaggtcgaaaaatggcgtaaatccgccatttttgaaagaagaaggccccggtaaacacagttgctgttgcagcgatatcaaaactatgctatgatatcatgtggtttatttccgtgagcagcgagccagacggacatgtctgcatgtccaatgggcggttttcgcaggcggcggatcatgtcggattatctgaatgactggaatcagtcacagatgaaagagaggaaacgaatataatgcaccagtatctgattgtatgtccgctggtattcttagccggtttcgtagattccattgccggaggcggcggtctgatctcacttcccgcctatttggcagcaggggttccgcctcatttggcgctgggaacgaataagatgggatcgaccatgggaacggtcatctccacggcgaggtttgcgaagagcggctacatcaaatggaagctgtccttatttgcggcggcctgtgcgatcgtcggttccattatcggttcgaacttatctctgcttgccagtgagaagtttttaaagggaatgatgctgttcgccctgccggttgtggctttctatgttttgaaaaataaggatatgggcgataataggaatacgggaagtcttacggagaagcagatgatgctgatcagcatggctgccgcgctggtgatcggtacatatgacggcttctacggcccgggaacgggtaccttccttctgttagttttaacaggggcggcgaagatggacttgaggaccgcatcgggaacgacaaaggtgattaacctgtcctccaatattgcggcgctggtgacatttttaataaatggaaaagtactgcttccgctgggaattacagcgggcgtgttctgtatcgcgggccattatatcggctccggtatggtggtaaagagcggccagaaggtcgtgcgcccggttgttctggtggtgctgttgtgtctttttgtgaaaattgtgaaagggtaagggattgctatgaaatggaagaaatttacgctgaagaccacgacgcaggccgtggatttagtcagcagcatgtttgatgagatcggaatcgagggaatcgagatcgaggacaatattccgcttacggcggaggagacgaaggggatgtttatcgatattcttccggagctgccgccggacgagggtgtggcgtttgtcagcttctatctcgacgacagccaggacatcgccggcatcctgaagagtgtggatgagggacttgatgacctttccatgtttacggatctgggagagcggaccatcaccgagagtgaaacagaggataaggactggatcaacaactggaaacagtatttcaagccgtttaccgtggatgatatcctgatcaagcctacctgggaggagattccggaggaacacaaggacaagcttctcattcagatcgatccgggaacagcgttcggcacgggccagcatgagacgactcagctctgtatccgccagctccgcaaatacgtgacgccggagacggttcttctcgatgtgggaacgggaagcggaattctgggaatcacagccttaaagcttggtgcgaagacggtgttcggtacggatctcgacgagaacgccattacggcggtcggtgagaacctggaggccaatggaattgattcagagaaatttgcagtccttcagggcaatattatcgacgataaagatgttcaggacgcggcgggatacgaaaagtatgacgtggcggtggcaaatattctggcggatgtcatcattctgcttcagaaggaagttccggtacatttgaaaaagggcggaatctttatcacctccggcatcattaatatgaaggaagaggcagtgagggcggcatttgcagccaacgacgcctttgaggtgattgaggtaacgtatcagggtgagtggctgtcggttacggccaggaagaaatagggaagagtatgtatcattttttcgtaaatcaggatcagatcgggccggaggcagtcacagtcacagggcctgacgtgaaccatataaaaaatgtgctgcgcatgaagccgggagaagaagtcctgatcagcaacggtgtggacagggactatttatgtaaacttgagacgatcgcggcggacagcgtgaccgcggcgatcgtctcggttacggagggcggtacggagctgcccgtgaaattttacttatttcaggggcttccgaagagcgacaagatggagctgatcattcagaaggcagttgaactgggggtctatcaggtgattccggtagagacgaggcgtaccgtcgtgaagctggacgcgaagaaggaagacgcgaaggtgcgcagatggaacgctgtctcggagagcgcggcgaagcagtcgaaacgcctgattattccggaggtgaccggtgtgatgtcatttcgagaagcgctccagtacgcgggtggattcgataagaacatcattccgtttgagcatgcggaagggatggcggacacaaaggcgtattttacaggaatcaggccgggtatgagctgcggaatcttcatcggcccggagggcggatttgaggatgatgagatcgcgatggcctcgacggccggagtgaagccggtgacacttggaaaacggattctgcgaacagagacggccggactggcagtgctgtccgtcttaatgttccagatggagaattgacgaggagaattaacgaggagaatttaaatggaagtttattttgataattcggcaacgacgaaggtgcttccgtcggtggccgatcttgtgctgaaggtgatgacggaggattatggaaatccgtccgcgaagcatggaaagggcatgcgcgcggaacagtatatcaaagaagccgcggagatcatcgccgggacactgaaggtatctcccaaggagattatattcacctccggcggctcagagtccaacaatatggcgctgacccggacggccatagccaataaacgggccggtaatcatatcatcagcacctccatcgaacacgcctcggtctacaatccgctggcgtatttggaggaacagggctttgaggtgacatacctgccggtggatcatgacggccatatcagcctggaggatttggaaaacgccatccgcgaggataccatccttgtatccatcatgtatgtgaacaatgagatcggcgcggtggagccggtggaagagatcgcaaagcggatcaaaaagaagaatccggcgattctgttccacgtagatgccattcaggcgtacggaaagtttgtcatccggccgaaacggcagggaatcgatttactctcggtcagcggccataagattcatgctccgaaaggaatcggttttctgtatgtggacagccgggttaagataaagccgctcatctacggcggcggccagcagcggggcatgcgctccggcacggaaaacgtaccggggatcgccggactcggtgaggcggccagggagatgtatcagaaccatggcgagaagatgaaacagctctatgagttaaaggattacatgataaaacgactggatgaggtcgagggaaccacggtcaacagccttccgggagagttgtccgctcctcagatcgtgagcgccagcttttccggggtgaggagcgaggtgctgcttcacgcgctcgaggacaagggaatctatgtttcgtccggatccgcgtgctcctccaaccacccggcggtcagcggaaccttaaagggaatcggggttaaacaggagctgctggattccacactgcggttcagcttcggtgtatttaatacgaaggacgaggtggatatctgtatcgcagcgcttaaggagctgcttccggtgctccggaggtatcagagaggctgacagctatgaacaatcagaacggctgacctggcagaaggccgcaatgctgaactgggctttcagaacggaatgcccggcagagaaaagaaaggatcaatatgcagtataaatcatttttgataaagtacgccgagatcggcgtaaagggaaaaaaccgttttatgtttgaggacgctctggtgacacagatccggcacgcgttaaaggatatcgatggagattttatggtggtgaaggagtcgggaagaatctatgccacagcggaatccgagtacgattttgacgaggcagttgagacgcttaagcgtattttcggcatcgccgccatctgtcccatggttcaggtggacgataatggatatgaggacttaaagaaacaggtgctcgcctatgtggatgaggtttatgaggataagaattttaccttcaaggtaaatgccagacgcggcaataaaaagtatccggtaaattccgaccagatcaacagggatttaggggaagtgattctggaggcgtttcccgagacgaaggtggatgttcatcatccggaggtcatgctccatgtggaggtgagaaaccggatcaacatttactccatcgtcattccgggaccgggcggtatgccggtgggaaccaatggaaaggccatgctgctcttaagcggcggtatcgatagcccggtggccggttacatgatctcaaagcgcggtgtgaagattgacgccgtttatttccatgctccgccttatacgagtgagcgcgcaaagcagaaggtggtcgatttagcgaagctggtatcgaggtattcgggaccagtccatcttcatatcgtgaattttacggatatccagctctatatctatgatcagtgccctcatgaggagctgaccattatcatgagacgttacatgatgcggatcgccgagagactggccgtggatgccggagcacaggctctgatcacaggggagagcatcggtcaggtggcttcccagacaatgcagtccttagccgccactgacgcatcctgtacgatgccggtattccgtccggttatcggatttgacaaacaggaaatcgtggatgtagctgagaagatcggaacgtacgagacatcggttctgccctttgaagactgctgtaccatctttgtggcaaagcatccggttacaaagccgaatttgaagatgattgagcgttcggaagaaaagctgaaagaaaaaatcgacgaaatggtggagactgccatcaatacagtagaaaaggtatggtgctgatgcatcggacgaactttcccgtgaaagaacaaagagtccggctcgccggactctcgcgccggagcgcggttgcttcagcagccaaacttccttagcgcggagtgcgcatacccgataaagcggggtacgctgtcctgcccgggggctttttatgtaataggagcaccttcctataacataaaaagcttcaaccgtgagacacggttgaagcgcttacttgtccgattaatcaacgatgtatggctttaagatgtttacgatctcatccacgctgctctcagaatgaatgtttaaatcgatcggcttggataagtctaaactgaagatgcccataatggacttggcatcaataacgtatcttccagataccagatcaaaatcggtatcgaacttggttaagtcatttacaaaagattttactttgtcgatggagtttaaagatatacgcactgttttcatgtgaaaaaacctccttgagattgttctttttttgatcagggaatccccgcttgttcaagttcaatactactggcatatgggttaaaagtcaatggtaattttacatgaaaataaacttcacatactgtttatttagataggagaaaataaaatgagaaaggcagccctgcataaccttggatgcaaggtgaattcatacgaaacggaggctatgcagcagcttctggaagaggcgggatatgagattgttccatttgccgaaggcgcggatgtgtacattatcaacacctgttcagtaaccaatatagccgaccgcaaatcgaggcagatgcttcaccgggcaaagaagatgaacccgcaggccgtggtagtggcggcaggctgctacgtgcagtcggcaggagaggcgctcaaactggacgaagcggtggacctggtcataggaaacaacaagaagactgagcttgtgagaatcctggatgactactttgcaaacgaagaccacaccgtggaagagacggtaatcgatatcggggcggcaaaggattacgaggccctgaccatcaaacggatcgccgaccacaccagggcgttcataaaggtcacagacggatgcaaccagttctgcagctactgcatcattccttatacgagaggccgggtgcgttccagaaagctggaggacgtgcgcgccgaggtcgaacggctggtggaagcaggatataaggaaatcgtgctgacagggattcatttgagttcctacggcgtggattttgaagaaggagagaagaagacgcttctcgacttaatcgtgtgtctccatgaggcagagggactcttaagaatccgtctgggctctttagaaccgcggattatcacaaaagagttcgcggaagcgctggcgtcccttcccaaaatctgtcctcatttccatctgtcccttcagagcggatgtgatgcgacgcttgcgcggatgaaccgccactacacgacggaagactatttaagccgctgtgagatcctgcgggcggcgtttgactgtccggcgattaccaccgatgtcatcgtaggcttcccgggggagacagaagaagagttccagacaacagaggcgttcttaaaggcggttcatttttacgaaatgcacgtcttcaaatattccaaacgcgaaggcacccgcgcggccgtcatgccctcccagatccctgagccggtaaagaccgaacgaagcggagtcctcctttcgctggaaaaagaaatgtccctggaataccgaaagcagcatctcggaaaaaccaccgaggtactgatggaagaagagttcgagtgggaaggaaagcgatatatgatcggccatacaaaagagtacattaaggccgcggtaccgtttagagaagacctgaaaggaagaatgatttccggcatacttgagaccctactaaacgacgaagtatttctcctaaaaaactaagaagatccattcagcctctaccctccgccgctttccatcttttttatcgcagcggagccagtacacagccgaaattccgcagggggtgagggcgcatgtgtattccagtgtgccggcatctggatacgagttataagaaagtccggaccaggcgaacacgccctggtttggcgtgtacgtctggtccggactttcttatggcgagtaggaagcaagacggacacggaatacacatgcgccctcgccccctgcggaatttcggcgtaacttatccctagaaaattcaggaaaatcaggaatttttatttttttcttgccgaaacagcaaatatggtttagaatagagaagaacagttaaaggacgtgagcgtaatgggcgatattcataatacacaattttttggttcagtacaggaaaacaagctggatgtaagccaggttctggagcaggtctatattgccctttcagagaaagggtataatccggtcaaccagatcgtgggttatatcatgtctggagatcctacttatataaccagtcataagaacgccagaagtctcatcatgaaggtagaacgggatgagatcctggaggagcttatgagggtctatatcgatacgatgcttaagtaattttacgtggtaaagagaatctgtaatttgactgtcagatgaaggaataaacggactctggcagttgttttttcgtgttgaaaaaataccggttttatttccagcggcagcagtcagagagacatgcgggcatgtttatccggtaactgctgcgggagccaataccccgccacctgcggggcgcaaatgtgatgccccgttgtccgcggcggggtatttgaattttgctgcagttcctcagataaccgatagaatggctgaactggagcttttatttccgcaggcaatgagtcaggcggacatgcccgtatgtctgtccggcggccgcgagggtcagggatcctgccgttagcggcgggagatttgacgaatatggagaaaataaatatgagaataatgggccttgactacggttccaagactgttggcgtcgctgtatccgattcccttggcattactgcccaggcggtggagacgattacgagagaagacgagaacaaattaagaaagacttgcgcccgaattgaggaattgattcgggaatatgagattgaaaccattgttttgggttatcctaagaatatgaacaatactctgggagaccgtgcagagaaaacagagagctttaaagccatgctggagcgcaggaccggactgccggtggtactctgggatgagaggcttacaaccgttcagtcggaacggattttacaggagagcggagtcagacgggaaaaccggaaggcggtcatcgacaaagtggcggccggattgattctgcagggctatttggacagtctgccaggcggcacgaccagaggagaatgacgaacgatgagcaacgaagaaaagaagatcacattggtgacagatgacggcggagccgtagatttttacgttctggaagagaccagaattaatggaatgagttatctgctggtgacagatgcggcggatgatgacgaagaaggagaatgttacattctgaaggacttatcggagagcgacgatgcggatgctctttacgagttcgtagaggatgataacgagatagattatttatttaaaatattttccgaactgctggaagacgcggacgtggatattgaaaagtgatgaagatttcattgttaggaaataacggattttgagggactcgtatatggaacaggaagtttttaaagacatgcttcgtaaaaagggactcaaagtgacaaatcagcgcatgctggtactggaaatcatggcggagcgcccgggtgaacatttaacggcggaggacatctatgacctcgcgaaaaagaaatgcccggagatcggactggccacgatatacaggaccgtgcaggtactggtggatctgtcggtaatcgataaggtgagctttgacgacggttttgcccgctatgaattagggggccttgaaagtgagtccagacatcaccatcatcacgcaatatgcagccgctgcggcagagtattttcatttgaaggagacctccttgatacactggagcagaccatttccgataccatgggatttaaggtgacggatcatgaggtaaagctctacgggtactgcagggattgtcagaaaatcatggaaaaagaagaacaggacggaaaatagatagaaaaatggaggtaacagattgaagaaacaggacagtaatgcaaaaattaagatcattcccctaggtggaatggaacagattggtatgaatattaccgcgtttgaatacgaggacagcatcatcgtagtggactgcggacttgctttccccagcgacgacatgctgggcatcgacttagtcattccggacgtaacgtatttaaaacagaacatcgacaaggtgaagggatttgtgatcacccacggccatgaggaccatatcggggccctgccatacattttgaaagaggtcaacgtgccggtctacggtacgaagctgaccattgcactgatcgagaataagttaaaagagcacaatttattaaagaatacgaagaggaaagtaatcaagcacggacagtccatcaaccttggatgcttccgtattgaatttataaagacaaaccacagtatcgcagacgcttccgcactggccatctattcaccggcgggcgtgatcctgcacaccggcgactttaagatcgactacacgccggtcttcggtgagccggccgatttagagcgtttcgcggagctgggcaagaagggcgttctggccctgatgtgcgacagcaccaacgccatccgcccgggatttaccccatcggaaaagacggtgggaaagacatttgacaatatctttgcagatcataaatttaaccgtattatcgttgcctcttttgcctccaatgtggaccgtgtgcagcaggtgatcaactcagcggccaaatacggacgcaaggtcgtggtagagggacgaagcatggtgaacgtcatcggaacggccagcgaactgggctatatcgacatcccggagggaaccttaattgatatcgaccagctgaagaattatccggacgagcagaccgtgctcatcaccacaggaagccagggagaatccatggcggccctttcccgtatggcgggaagcacccacaaaaaggtatcgattaaaccgaccgatgtgatagtgctcagctccactccgattcccggcaatgagaaggccgtgtccaaggttatcaacgaactggccatgaagggcgccgaagtaatcaatcaggatactcacgtatccggccatgcatgtcaggaagagatcaagctgatctacgctctggtgcgtccgaaatacgcgatcccggttcatggagagtaccgccatttaatggctcagaagaatctggtacaggctatgggtattccgaaggacaacatcgttatcatgtcctctggagacgtggtggaactgggacaggagtcctggggcatcgtggatcacgtttcagcaggcggaatcctggtagacggactgggtgtcggcgacgtcggcaatatcgtgctgcgtgacagacagaacctggctcagaacggtatcatcatcgtcgtgctgacgctggagaaatacagcaatcagctgctggccggcccggacatcgtgtccagaggcttcgtctatgtgagagaatccgaggatctgatggaggacgcaagagcggtcgtgaatgacgccgtgatggactgcctcgaccgccatgtcaacgactggggcaagatcaagaatattatccgcgacagcttaagcgatttcttatggaaacggatgaagcggaatccgatgattctgccgattattatggaagtataggataagcatcaaagaatcaggactttcgtgttgaaagggatgacagtatgagccgtgctacaaaagagatcaacagaataacgggagccatcatcgggatatccggaaggctgattgtctgcgcactggtcgtgctgcttctttacgaaggcgtgacaaagggctatgaattcggccatgaaattttttacgccacgtctgtggaagccgcgccgggaagagacaggagtatcaccgtggaggagggaacctccatcacggatgcagcgaagctcctgaagtcgtacgggctgattgcgaatgaatattcatttgtcatacaggccatcttcttcgactacgaagtgaaccccgggacgtacaccgtgaacacctctatgacctccaaggagattcttcagatgatgaacgaaaataccggagaagaggaagagaaggaatgatagggaacgagagagtcacggactacatcaattcgctggagagaagccggggaacgctcctttcggagcttgcgtcaaaggcccggaaggaacgggtgccggttatccgcgaggagaccgcctcattcctgatctctctggtggaggcgaagcggccggcggctatcctggaggttggcaccgcggtgggctactcgacacttttaatggcgggggccatgccggagaactgccgcataacaacgattgaaaaatatgaaaaacggataccagaagccctggaaaacttcgagagagcgggggagagtgaacgaatcaccctgctccccggcgatgccggagagatcttgaagaaacttaccggtccctatgattttatattcatggacgcggcgaagggccagtatcttgtatggcttcccgaaatcatgagactcatggttccgggaagtatgcttgtctcggacaatgtgctgcaggatggcgatatcatcgaatcgcgctatgcggtggaacggcgcaacaggacgatccatgcgcgtatgcgggaatatttatacgaattgaaacatacggacagcctggccacgtcgatcatacccatcggggacggcgttgcattaagcgtttttagagaaagagatgtaaaaagatgagaaagacagaactgcttattccggctggaagtctcgaggtgctgaagaccgccgtgatttacggtgcggatgcggtctatatcggcggtgaggccttcggtctgagagcgaaagcaaagaattttacgaatgaagagatcaaagagggaatcgcctttgcccatgaacacggtgtaaaggtctatataacagccaatattctggctcacaacgatgatttagcgggtgtggaggcgtattttggagaactgaaggagatcggtccggatgcgctgattatctcagatccgggagtattcgccatcgccaggcgggtgatacccgatatggagatccatatcagcacccaggctaataatacgaactacggaacgtaccgtttctggtatgatctgggggcaaagcgcgtggtaacggcgcgtgagctttctttaaaggagattaaggagatcagagaacacattccggaggatatggagatcgagagcttcattcacggagccatgtgcatctcctactcagggcggtgtcttctgagcaattttatgacgggccgggacgccaaccagggggcctgtacccatccctgccgctggaagtattccatcgtcgaggagaagcgtccgggtgagtacatgccggtttatgagaatgagcggggcacgtttatctttaactccaaggacttatgtatggtcgatcacataccggagatgatcgatgccgggatcgacagctttaagatcgaagggcgcatgaagacggcgctctatgtggcgacggtggcaagggcttaccgaagggccatcgatgattaccagagggacccgaagctttatgaggcgaatttagactggtatcgggaagagatcgccaagtgtgtcaaccgggagtttaccacaggcttctatttcggaaagccggacgcatcgtcacagatctacgagaacagcacgtatgtgaaggattacacgtatttgggaacggttgcttcggtggatgaccggggctatgcgagaatcgaacagaagaataagttttcggtgggggaaaccatcgaggtgatgaagccggacggaacgaacagagaggtagtcgtcaaagcgatttacgcggaagacggaaccccgcaggagagcgcaccccatgcacgccagatggttgatgtggatctggggcttgcgatggatccgtatgatatactccggcgttgtgaggttggaggggaatagtcataagcggccaaagcaatggcaaaagcgtatcagtaagatgtgacgcttttgccatttttgctgtccaagaaagcgcataaaccggctatatgctcttagacctgcttccacaacacaagagaaacttcaaattcatcttcatcaggagtcagatagaactggcccccgtttgcctctgccatgctgcggacactggagaggccgattccggctccttcgtgtttggtagagtaaatacggtcttcaaggacggtaaattctccattccagtggtttttcacggtgatcagcaggttgccctttgcaatctttgcgtatatttttacggagcggagctcctggggcagcttttcagaggcttcgaaggcattttccaggagattgccaagcagaactccgaggttccaggcttccagctttaattccgccgggagagaaacatgaatggaaagtggtatctgcttctgtaatgcgcgctgccggtagtaggtgagaaccgcgttagctgcgtggttatcgcagagaaccggccattcggtctgctcagaactgttctcgtagccttccagatagtcctccagcgcatcatactgcttctggttggtaagttccttgattgccgtgatatggtggcgcaggtcatgccgcatcttacgtgtctcttctatgctttttgacaggatccgatagttttcttcctggagggcgaactgtcccttcatcagccgcatattctcagcgagtgcggtacgttccgcataggctcggatcgtatcaaaccagagtccgccggccaggagaaggataaagaggaatcctgcattttctgtctgccatccaaaacgcactggctcaaagaccggagcggccgcctgaaccagaagggcgacggcgattgtacagagacctgccaggagtaggcttcgcatggtctccgtctgttccctgttaaagaatgcagtggtaatgagccagctgaaaagaacgagtttgaagccgtctaagaagactgagtagagcagcatagcagttaagcttccgtttaacagcagagcgggaaccacaagagaagccagagctgcagctgcacagacgaaaacggcaaatcgttgcggcctgcctttgataccgcagagactgcagtgcagcgcacagattgcggtaagaaacaggtaaaagcttaaatcttccagataataggtccagtatccggcgccaaataaatgaaagagcggatacatgacatgcatggtgaagaacaggcatacaagagaaaacagtatcatgcgtctccgttccccgccggttttgatgccaatgaaaagatacaggattccgatggtcagtgatgcaatgaccatgatacatgtgcgcagaaatcggagggaaattaaatcggatactgcatctgttgatccgaacgccggaggatagaccatgccgctgtaatagtgacgtgtatccgcggcctgtacgaccagctctgcttttccagccgcggagaaggtaatcatacctgtgcggatggagggggacggattgacggaggttacatcacctaagatgctgacaggccggccatttacccagattcgtgaggcggaatagatttcaggcagttccagcgcatattcgtttacttccggaggaagcaggatggtcagccgatacgtggcgcagccatgaggattgccgtttttatctccggcttcaaaacctccgtactgtcccagatagataaaatgaggcttctgcccgttaaattcgccgggggcaatcagcttttgcggatagatttcccagccataggtcagaacagataatggctgcctgtctgaccgcagatcaagaatcccctgctctccctgtattccgggaaaatggtatttgttgtcataccggtattgcaggaaaaacagaaggatcgtgcatagtacgacgagcagaagcaggcagagccgcttaaggtaaatgtttttcttcataaactgcacatggagactcgtgcctttagacatgagaggaattgtgcccctcctgactctttcgcaagctccttctcctttttgttttttaacttctcgaacgtttgtttgatttttacttctgattgtggtaaaatatattcagtccataatctattatgaggtataaaatctatgaaatctattactattactgctaaagtcaaactataccctacatcagagcagatgattattttgaataagacactgtccgttatccgggctgtgctgaactttgtctccgcattcgtttttggacaggaaggcatccgctatctcgaattaaaccatgccttatactacccggtcagacaacagtttggactccgctctcagatgacacagagtgtatttaagaccgtccttgcaacgtgcaaaagcccttgccctgcgcaagcgcctgcagacatgtggaacaaaatcagcaaagcgtaagcttaaaaagctccgtgagaaagaaaaccgttacgtaaccgcggtaaaccatgcggttacgaaggcacttatctcacagtatggagcaggtacgctttttattatagaagatttaaccgggattcgtactgtcacggagcacgtccgtttcaaatcccgatacgtaatagtctcctgggcgttttaccagttccgagagatgctggaatacaaagcagcgctgtcgtattcagaagtccttgcgatagacccgaagtacaccagccagagctgtccggtctgcggtaatacaacaaaggctaaccgtaacagaaagaagcatgaattttgctgtactgtctgtggttaccggagtaatgacgaccgtaccggagccataaacatttaccgtaaaggatgtaacactctgttcgcagaggcctgttaggcagaaccgaagcaggcgggctgccgtcaatcagcctgttgtagccaatgtttgaggtaggagacatgaatcacatgtcgtactacgtgtagttgagttacaagcccgtgcctttagacatgggtaattgacgattatcttttccttatcattcgcaggcctgcgaatgcaccgcctgagactgccgcgattcccacgagcagacgcagagggagaaagagagaacgcggtgacgcggtatgaatttcttctgttttgtcaggaaccgtctctttcaccgtgttagccggggcattagccggtatatcggagacggattcagtgggatcagacacgttctccgactgggaaactggtgcagggggcttgagtacggcagtttggtatggattgtcgtcatgtttgtttggaacagtgaagatggtgccggattctgaagtattatcttttccgcccccggatttggaggcattcctttcggtagttttcgtgggaggagcagtcggtgtcccgttgggaggaaccgtcggtgttccgttaggtggatcagcgggtgtattcgtgggtggaatcgtcggtgcttcagtgggaggagcagccgatgtattcgtgggaggaaccgtctgtgttccgctgggaggagcagtcggtgtattcgtgggaggaaccgtcggtgcttccgtcgtcggctctgttggattggaatcaggtctatccccctcatcgttcttgtcaaacaatccttccggtggtttctcaaaacgctttccgccgccgcggtcacctccaatatcggtagagtattcaaaccgtcctgttgccgcattgcgggtaaccgttacgtaagcagagtagcgctccagatcggaagcctccgcctgctcaatttgaaaggaatagcccatatgatccaagtaggtatcttttaaattggagacggagagagaatcgttacgaagcgccgtgctgctgctgtctgtaatgtcataccaattttcgccccagtcggtggaacaccagacagtcagactggtaagatcgtcaaatgtcagagggattgtgtctttctcagtcacggagaagaaattcagcttcacctgattctttccctcgggagtatcttcagatgggaataaaacaaaatcgcagttttccgaataaatcgaaatcgtcagcgtaagctcaggcatggattcaaacttcagaagataaccgtactcctcttttatttcgtcagagaactccccatgtatgatcgtatcgcctttccgattccaatcaacggcgtccagctcatcctgattccattccaccggaatcaatttttttgctttccacaggccgttcggtttgtccccatagaaaaccgagattgtattataaaagccccaggcgatatcttcctggcagccgatggcagcccgggcgatgagcggcaggggatcgtaaacatgagggttgccaatccggtaatccagaatctggtaaggaccgttttcgctgggatcgtcatcccagttactgtttccccagtccgctccgcccatttcgccgccagacggaatgatggagacggtttcaatcattccgtcgcctccgatatcggccttcacaatgtcggaatggtatgacaaaacaccgccaaggcgaaggtccgtgacctggaataagctgtcttcctccacaccggaaatcgtaagatggtcttcctccgcccatacccggttgtctctggtaatattgcgccagtttgttccgccgtcacggctttcgtaaagttcatagtttaaatcggatatggtataggggtctccattcatgacataggagagcgtcaggatattcccagctgtttcaggagtaaagctcagcgtgcctccctggtccactttgatgataaacgaaaggagcggcgcatgatcccagtcgaccggaacttcacaggaagcggtatccagaatgcccgttaccctgtattctccctcactgttaaaatccacgccagacaggtcccaatctacagccagccagagcggatcataaagaaaaccgtcaggcccctctaagtatacgtcgatacagattggaagctgttctgcatcaggattaaattcggcccccattttgacaagcatcggctgagataagcaccaaaaatcataggaagagacggtgtagaggatgccgtctgattctgcgggtgattccgctacctttccgtctccccggtctgggtcagaggccgcgttacctggagtggcccgattctggtcagtactgtctccggtttccgtttccgtccctttctctgtatccgatgcggtttctgtatctgaggaggcgttgcctgtatctgaggaggcgttgcctggagtagccggattaccgtttactgtagtatgtttgacttccgccgagttggcgagagcacttacaaaagttcccgccatggcggagaacagtacggtggcggtcatcacggcgtatactgcaaaacgatgctttctcatgttttatcccctgttatagtaacggtcaggtaacggccgtattctctctcaaatgttttttcacaggtccggcttaaggggaccttatcacctgaacttaagtacagatcatttccattcctttttgtaatgtaatccatgtttaccagataactgcggtgggtgcgcagaaaacggctgtcagagagctgatgcatcactgcatccagtgtggagcggagcgtgatgtcggaatcagcatgaatcacggtttgattccggaatacttctacaaatcggatttctctgagggggaggcgaatttctttccctcccgcagaaaagaaggcaaatttagaagaagctgtcagcacttgttgacaccggtccagtgccattttcacccggtcataggtgaccggttttaccaggtaatgcgcggcatcgacctcgtagcttctggcgtaatgctcggtactgacagtgacgaagataatagcgcagtcattaccatttgccctcagaatttctgctaaatccatgccggacagaggagacatatagatatccagaaatagtattttgatatccggatcctgactggccgcttccaaaagcctctcacttttactaaattctaaaattgtataatcgaaaagattatcaagagcatattgattgatgaatttgcgcaattgattgagaacaggctgctcatcgtcacatattgctattttcatacaaaaatcccctctctgtttccacatattacagtctatttaatcatagtagcaggattgctgcaagataaaaattaccaattgtccctttttcacgccaattatcccatttttatttctaaaaaagtaatttggatttatttttaaagaaatattataaaaatatgtttaaaacaagtgtataaaatatgttttaaacgataaaacaaaggaatttgataagacctgaaaacggacaggtatggaggggcagctatgcaggtggcaatttgcgatgatgatgtgacagaccgcgtaaaggtcggggagttgctggcacaaaagatgaggaaacggggagaagcgttggagatcacctattttgactgtggagaggatttggtggatcagtttgagagcggagaagggcgttacgacctgatatttttggatatttatatgaaatttatgaatggtatggaggcggcacggcagattcggcgctgggaccagcgggttgcacttatatttctcacagccagccgggagtttgccgttgaggggtattctgtcggtgccagcggctatctgctcaaaccggtcgagcaggaaacgtttgaggaagccctcaaccggttctttgcagaacgctatcccaggctgcgtaggagccttctggtggtcaacggaagcgcaggcagacgaattgcctatgatgatatcatgtatattgaaagccggaggatgaatgtacggattgtgtgctgccatggtacagagcattcaatacggaagaaactggatgaagtgcaggaagaactgtccggctgccggtttttaagatgcaacaggagttatatagtcaacatggattacattactgatgccgatgaagattttacgatggaaaacggggacaggattccgattaaggtgagggagaagaagcagattagaaagcggtattttgactatatgatgaaaaattgaaaaggatttttctgttaatggagcctggagctacaggctccattgaattaaaagagggctgtgacataactatggaaatggccggaggaatctatgcagccgtccgtaaataaaagaaggactgaaactggagagaagtattttgccgggttcggtccttttacttttctggtctcttacaatcaattctttttgcaggaagccgaacatgatactgctttttcttgtggaaaatcttcggttatggtatactatgagcacttagtgaggtattccacgaacttagcgggttctgaactctgatggaagcggaggtttcaatcatgacatggattttatggcttttggcggctgcctgtgtcatatactatgtagttatcgtcatttattcaggttttaccacttcattttcctttatctggatggtatttgcagcagcctgtctgctgctggcgctgggctgggaatactatatgaagcataaggaccgggtgccgctctggctgcccgtgtcggttatcacattctgctgcacggggattctggtgttttccatggtagagatcctgatctttaccggtgtggccagccgggatacgtcgcatctcgactatcttatcgtgctgggagccagagtaaaagaagacgggctcagcaaatcgttaaagagccgtctcgataaagcgatcgattatctggaggagaatccgggaaccgtgctcgtactctccggcgggcagggcgaggatgagccggtcagtgaagcggctgcgatgcgggactatctcctgtttaacggtgtgaacgagcgtcagctgattctggagacgcgttccttcagtactgtggagaatattgcctacagcagagtcgcgatcgaggaagatcagttgaggagaaaagcgcgtcatgccaggtcagacatctcgatggatccgggaacctatgaggtgatcgaggataagcccttgaagattggcgttctgaccagtgattaccatgtgttccgagcggagcagattgcaaaaaagtggggaataccggatatttatggagtttcctgtgaaaccgacccggtgcttttggtacatttctgcgtacgggaatgcgcggcgatattaaaagataaactggtaggcaacatgtaattatggaaataagaacagaagagtaagagtatgtaatttgtaccgggcggaagcaccggctgccgcaggcggggatatttccccgctgttttgctacagttaaggggtgcacaccgcccgtcattttatacaatagggatggaaaaatatggcaatatgtctgcagaacgccatatttccattctgttgtagaaccgccctacttgtggtatgctatattggactggaaaagtaaagttccgttcttcttttacacataataatgaaaacgccagagaatgggcaagatggtaataaagagaaaatgttaaggaaggaatgaagaaatatatgagacagttagaaaatttggcagcctatgaggttgtggaagaaagacagttggatgagatgaaagccacaggaaccgtgctgcgccacaagaaaagcggagcgcggatttttgctgtatcatgtgacgatgagaataaggtattttccattggattccgcacgcctccggaggacagcaccggcgtggcgcatattctggagcacagcaccttatgcggttctgagaagtttccggtaaaggatccgtttgtggagctggtaaagggatccttaaacacgtttttaaatgccatgacgtatcccgataagacggtttatcccgtggcgagctgcaatgaaaaggacttccagaacctgatggatgtctatatggatgccgtttttaatcccaatatttataaggaaccgaatattttcatgcaggagggctggcattacgagctggagagtcccgaagcagatctaatctataacggcgtcgtctataatgagatgaagggggcgttttcctccccggaggaggtcctggaccgttatacgagaaaggttctgttcccggataactgctatgggcaggaatcgggcggagatcccgcgtttattccggatctgacgtacgatcagttcctgaattttcataagagatattaccatccctccaacagctatatctatctgtacggtgacatggatatggcagagaagctggaatggctgaatgaccagtatctctccaaatacgatatcgctgagatcgactccaggattctgccgcaggagccgtttgaccggccggtggaggaagagacccattactccattactgacggagagtccgaggagcaggccacctatctttccatcaataccgtggttggcaatgacttggacccgcagctttacgtagcgttccaggttctggaatacacccttctggatgcgccgggagcaccgcttaagcaggcgctcatcgatgccggaatcggccaggatattctgggcggatatcagaacggcatccttcagccctatttttccgtaatcgcaaagaatgcggataaggagcagaaaggggagttcctcgcagtagtaaagggaacactccgcaagctggccgatcagggaatcaacaaaaagagcttaaaggccggattgaatttctatgaattccgttaccgcgaggcagactacggttccgcgcccaaagggctgatgtacggccttcagtgcatggacagctggctttatgacggagatccaatgatgcacctgacctatcagaagaccttcagttatttgaaaactgtggtggatgagggctatttcgagcagctgatccgtgattatctgctggataatccgtttgaagccgtattggtggtcagcccggagaagaatctgacggcaaaggaagacgagaagacggccagacgcctggctgcctacaaggcctcgctttcggaggaagagatcgatgctctcgtcgagcagaccagggcgcttagggagtaccaggagacgccgtctttgcaggaggaattaaagaagattcctatgctttccagagaggatatcggcagagagccggaggagattatctgggaagagaaagaggtcgaaggcgtgaaggtgattcatcacgagatgtttacctcgggcatcggctatctgaaactgctgtttgacacctcccgtgtgccggaagaagacttatgttatgtcggcctgctcaaatccgtgctgggattcgtagacacggagcattacacgtatggggatctgacgagtgagatccatttaaacagcggcggcattaatttaagtgttacgtcctatccgaatttaaagaacagcgctgatttcaaaggcgtatttatcgccagcgtcagagtgctgtatgacaagctggacttcggtttctccattctcggtgagattctgaagaattccattctggacgatgagaaacggctgggagaggtaatcagtgagaccagatccagaggcaggatgaagctggagggagcatgccattcggcggctgtagccagagcaacctcctatttctcaccgacctcctattataatgacaacaccggaggaatcggatattaccagttcctggagcagttagaccgggattacgcggatcgcaagaaggagattatcgccagattaaagcaggtgatggagcgccttttcaccgtggaaaacctgctggtcagctacacggccgatgaggaaggcttccggcagcttcccgcggcgcttcggaaattaaaggaaatgcttccggaaggcagcaaagagacgtatccatttacgtttcctgccggcaaccggaacgaaggctttaagacggcctcccaggtcaattacgtggccagatgcggcacctttgccggaagcggatacggctatacaggcgcgctgcgcatcttaaaggtcatcttaagctatgattacctgtggatcaatttaagggtaaagggcggcgcctacggctgtatgagcggcttcggacgttccggcgaagggtatctgacctcctaccgcgacccgaacttaaaagagacgaatgagatctatgagggcattgtggagtatctggagcatttcgaagtggatgaccgtgacatgacgaagtatgtcatcggcaccatcagcgatatggacgtaccgtatccgccttccacgaagggaagccgcggcctgtccgcatacttgtccggcgtggatgagggtatgatgcagcaggagcgggacgagatattaaatgcaacaaaggacgatatccgtgcgctggcgccgatcgtgaaggcggtccttgccaccggaagcttatgtgtgatcggcaacgaggagaagatagaagcgaataaggcgctgttccacgagacagagaccttgttccactcataaagatgagccgtctgaactgttgcaaaagaatgaaaaatgacatcgactacgaaggagaacgaatggacaatcaatataaatcgggttttgtaacactgatcggacgccccaatgtgggaaaatccacgctgatgaaccatctgatcggccagaagatcgccatcacatcagataagccccagaccaccagaaaccgcattcagaccgtctttacggacgagaggggacagatcatctttctggacactccggggatccacaaggccaagaacaagcttggcgagtatatggtgagtgtggcggagcataccctgaaggaagtggacgtggtgctgtggctggtggagccgaccacgtttatcggagcgggagagcgccatatcgcggagcagcttcagaacgtgaagacaccggtgatcctggttatcaacaagatcgacaccataaagaatcaggacgagattctggaatttatctccgcctacaaggatgtatgcagctttgcggagatcgttccggtatcggcgctgaaggataaaaacacggatctgatgctggatttgatctacaaatatctgccctgcggacctcagtactacgatgaggacaccgttacggaccagcccatgcgccagatcgctgcggagctgatccgtgaaaaagcgctgcggctgctgagtgacgagattccccacggaattgccgtcaccatcgagaagatgacagagcggaaaaacggcatgatggacatcgaggccacgattatctgtgagcgcgactcccacaagggaatcattataggcaagggcggcgccatgttaaagagaatcggcagcgcggcgcgccgggagatcgaggatctgatggacacccaggtgaacttacagatctgggtcaaggtccggaaggaatggcgtgacagcgaacagtatatgaaaaactacggatacaatgaaaaagaaatttagaaacgggtgatcgaagtgagagaggctgtcaggcttacagggatggtgttaaaggccgttccgtccggggagatggacaaacgtctggtgatccttacgaaggagcgcggtaaaatcacggcgtttgccaggggcgccagaaggccgggcagcatgctcatggcctgcggccgtccctttgccttcgggcagtttacgttatatgaagggcgggatgcctattccctgcagtcggcggaaatctccaattactttgatgagctttccacggacgtggagggaacgtgctacggctcctatttcctggagtttacggactactacacaagggagaatatggacggtacggccatgctgaaactgctataccagtcggtgagggcccttttaaagccggcggttcccaatgagctggtccggcgcgtgtacgaactgaaggccatggccatcaacggggagtacacggagaagccccccagagaggtcagcgactcggccaattacgcatgggaattcgtcgtgctgtcgccgatcgagcatctctatacctttgcgctgaccgacgccgtctcccaggaatttgggcggtgcgtggagattaataagaagcgctttatcgaccgggaatttcattccctggaaattctggaggcgatgacggggcggcggcctctgtgaaaagtgctgtctgatctattggaaaggtatggcggagggactcggctgtgccttttctttaaaaagaaaaggggaatgcgggtgaatataaaagaactgataggtgagacaaatgtttatgataaaaagcaggcattagaggaacgcagacctaaaagctggtgtaaaagtgtcagtgcatttgcaaatggaaatggcagtaagctgatttttggtgttgcagatgatgacactattacagggcttggtgatgtgaggcacgattcggaagtaatcagcgaacaaataaaaagcaggatagacccaatccccaagtttgatctggttattcaaactgtagacaataaagaaattatcattctggaaatcagcagaggactggagactccttattattatgtgagtgaagggacccgcactgcgtatcagcgggtgggaaatgagagtataccggttgatgccaggggtcttaaggaactgatattacgaggaattgattctacttatgacagcagcatttcacgatacgaatttgaaaattattcgtttactaaactgaaggcggcctataaacaaagaactggagaaaactttgacgaggacgattttatttcttttggcattgtttcggaggatggaaaattgacaaatgccggggcattgctggcggatgaatccccgatcagacactctcgcttattctgtacgagatggaacggagtggataaagcggcaggaactatggatgcgctggatgataaggaatttacaggaagtctggtggtgctcctggaaaatgggctggactttgtaaggactaattcaaaagtgaaatggaaaaagactggggaagagagaattgaactgccggactatccaagaagaagtgttttggagggactggtaaacgcattgattcatcgtcagtatttggatttggggagtgaagtacacattgatatttttgatgaccggctggaaatttactcgccgggtggaatgtgcgatggttcgtttatacaggagcgggatattaataaaattccgtcaaagcgcagaaatccggttattgcagatatttttaaccgtttgaagtatatggaaagaagaggaagtggatttaagaaaatccaaagtgtatatcagtctcaatatttatatacggataggctgagtccccaattttattcagataaagaaaattttattctgacgttgaagaatcttaattatgaaggagccgaaaaaggagccgaaaaaggagccgaaaaaggagccgaaaaaatgaagattcaaaaaatggaggagcgaaaagaaaaaatactgtcattgataaaagcaaatcccagtatcacacagggtgaaattatggaaaaattaaatctgtccagaaagcaggtacaaagtttaatgaaattattaaacaatcagggacagatccgaaggattggctctaacaggaatggttattgggaggtttcttgactataaactattgaaatgacggaatgcatttggtataatgctttcatatgcgccaaatgcaggaggatgatgaatgaaaaaaatgaaagcggtcctggcggttctcatcacagcggggatactcgccggatgtgccggaagagggggaacaagtacctttgagcctaagagcagcggcattttcgtgacggatgcgggaacattttcgacggctaccgttgagacgtacgacaaccaggattattataatgaagaggaatggaagaacttccttgaagaaaacgtggcggcgtataacgcggaacacggagagggagcggttaccttacagacatgcagtttaaaggaaggcactgccagcatgatctttgattatgcgacaggaagcgacttagcccagtttacggccctttatgaggacacagccaaccaggtgaactccatcgatatcattcccgtggctcaggccctggaagaagcgggggcggccggaacgatctttgtcaagacggcggacggcaagacggcatctacggatgagatcgcaaagaagaccgattaccacgtcgtagctgtggacggcggaccgataaagcttcagacagaaggaaagattatgtacacctccgacggagtaaaattaaacagcagcttcatcgcagagatctccgaaggaaagaattacatcatattcaaataaagaatccggattggatggaataaaagaagagaggtttgaggacatggaaaagacaatggaaaaaattgtagcgctggcaaaatcgagaggattcgtttatccgggttctgagatttacggcggccttgcgaatacctgggattacggcaacttaggtgtggagctgaagaacaatgtaaagaaggcatggtggcagaaatttgtccaggaaagcccgtacaacgtgggcgtggactgtgcgatcttaatgaactcacagacctgggtggcatccggccatttaggcggcttctccgatcctttaatggactgcaaggcctgcaaggagcgtttccgcgcagataagctgattgaggattacatggccgagcacggcatcacgatcgaaggctctgtagatgcctggtctcaggaagagatgaaaaagtacatcgatgacaacaatatctgctgtcccagctgcggaaagcatgatttcaccgacatccgccagttcaacttaatgtttaagaccttccagggcgttacggaagacgctaagaatacagtatacttaagacctgagacagcacagggaatctttgtaaactttaagaacgttcagagaacctccagaaagaaaattccgttcggcatcggacaggtcggtaaatccttccgtaacgagattacgccgggcaactttaccttccgtaccagagagtttgagcagatggagctggaattcttctgtgagccgggcaccgacttagagtggttctcctactggaaacagttctgtatcgactggctgaaggcgctgggcatgaaggaagacgagatgcgcgcccgtgaccacgctccggaagagctctgcttctacagcaaggcgaccacggacatcgagttcctgttcccatttggatggggcgagctttggggtgttgcggacagaacggattacgacttgacgcagcatcagaacacatccggccaggatatgtcctattttgatgatgagaagaaagaaaaatatattccatacgtaatcgagccgtctctcggcgccgaccgtgtgacactggcattcttatgttctgcatacgatgaggaagagatcggcgagggtgatgtgcgtaccgttctccatttccacccggctattgcgccggtgaagatcggtgtgcttccgctttccaagaagctgaacgagggtgcagagaaggtttactccgagctttccaagtattacaactgtgaattcgacgacagaggcaacatcggcaagcgttacagaagacaggatgagatcggaactccgttctgtgtaacgtacgacttcgattccgaggaagatcatgcagttacggtccgtgaccgcgataccatggagcaggtgagagttccgatcaccgaactgaagaactactttgaggataaattccgtttttaacgtggattccttgtgactgagccgggccgaccgtctccggataagaatacagatccggggcggccggccttttctctttactttcggagggagtgatcggatgattcttgaaaaattaaaacgcatggaggactttacccaccaggagcaggcagtggcgcggtacatcctggaccacgtggaggaaatccagcagatgtccaccgaggaactggccagggtatcctataccagcaaggccacggtggtccggctgtgcaaaaagctggaggtggagggctatcaggagctgaaattaaagctggtctcggagatggtgcagaacataagggtcaatcagcttctgagcaaggagccgatcacggagaagagcacgtttccggatatcatccacacgctgccgaagctgtacgacaaggccatcaccgacacggagctgtgcatggacaggaacgtcatgatccgcatctgcaaccggattaaggcggcggaccggatcgatatctatggcagcgggatcagctatatcctggctcagtcggcggcgtttaagtttgccaccctcgggatggagtgcgcggcgtacgagagcgtcaacgctcattatctgtccgcgggaaaaaagaagaaaacggtgtccttcgtgatcacatttaccggggccaacaagaacatgatcgaaaccgcccggtatttgaaggagacgacggagacgtacgtcgtgggaatcgtaggccgtcacaacgaggagattcgcaaatggtgccacgagatcgtggaaatcccctccagggactccctgctcagcttaaaggtgatcacctcctttacggccaccacctatgtcctggatatcttcttttccatgctcctggcccagacgtatgaaaagcatgtgaagtcctctctcgagatggtttgccatgagacgctccggatcggtgtggactactggaatctgaaggaaccgccggaggacgggggaaactcttgatgaaaggcacgataagaatctgttttgaaccgctgtttcaaaaaaacagcggtttttttgatgatttttgaaacggtgaaccatttcccgttttccgtagtgaagaaatgggtatgatgtgttacgatgagtccatcaaaagaaaagaggggaccgagtaaatggattataaaaaacttgcagaagaaatccttataaaaatcggcggagatgagaatatctccgggcttacccactgtgccaccagactccgttttaatttaaaggacgagggaaaggcgcagacggaggccttaaagaaagtgaacggcgtcatgggcgtcatcagcaaaggcggccagtatcaggtcgtaatcggcagcgacgtggccagcgtatacaagccgctgacggagatgtgcgagcacacggcggaagacgagagcggctccgggaaagaaaagaaggacgacaggaagatcgtagcgcggatggtggacacactttccggcattttcacaccgattcttccggccatcaccgcggccggtatgatcaaggcgatcctggcgcttttaacggcgttcagcctcgtggacaagacgggcaccacctaccagaccctgaattttatggcggacgctgcgttctatttcctgccgattctgctggcgaattccgcggctaaaaagttcaaatgcaatccttacctggcgatgatgctgggcggtatgctgctccatccggattttatcaatatggtggcggcctcgaaggagagcggggaagcgatccgaatcttcctgcttccaatcaccaatgcgggatattcatcctccgtacttccgattatcctgatcgtatggttcatgtcctatgtagagccgatcgcagaccggatttctccgaaacctgtgaaattctttacaaagcctctaatcacagccatcgtgacgggaatcgtgggcctggtggtcatcggaccgatcgggaccattatcagcaacttaatcgcctccggcgtacacagcttaaacaattactgcagctggctggtaccggccctggtaggtgcatttacaccgcttttagtcatgacaggaacccattacggactgatccctatcggcatcaacaaccgtatgaccatgggctacgataccctgatctatccgggtatgcttggctccaatgtggcgcagggcggcgcggctctggcggtagcattcaagagcaaaaaatctgagatcaagcagctggcctcctcggccggaatcacggcagtctgcggaattacagagcctgcactttatggtatcaacatccgcttcaagacaccgctgtacgcggccatgatcggcggcggtgtgggcggcttcctgatgggaatcttaaatgttaagaactattcaggcggttccccgggatttttgacactgcccagctatttaggcggcgacacactcaccagcttttactttgcctgtgcaggcgcggcggtcagtgtcgtgattgcgttcatcatttcctatgtactgtataaggatccgcaggacgaggacggcaaaacgagtgccaaagaccagcctcaggcttcctcaaatacgaagacggttttggttgctgctccgcttaccggcgaggccgtatccctggaaacagtcaatgatcccacatttgcggaaggcattctgggaaaaggcattgcgatacagccgtcggaggggcgcgtggtatctccggtgaacggaaccattgccacgatctttgaaaccggccacgccatggggcttgtgtcggaggacgggacagagattctgatccacgtgggcctggacacggtaaatttaaaaggaaaacatttccatgtaaaaatgaagtccggcgacacggtaaaagtgggagactgcattctggaatttgatttagaggcgataaaagcagaaggatacgatgtgatcacacccgtcatcatatctaatcattttaactacagttctgtcgacgcggcggctgaaggccatgtgaagacgggagaaccgcttttgaggctgcattgatggagggacgaatgatgacatttccggaaaactttttatggggcggcgcggtttccgccaatcagtgtgagggagcgtataacgaagacgggaaaggtctttctgtccaggatgttcttccccacggcctgcggggagagcggacggagggtcccaccgcagataatctgaagctggaagcgatcgatttctatcacagctacgaagaagacatccgtctctttgcagagatgggattcaaggtgttccgaacctccatcgcctggtcgagaatctttccggagggagacgaggagacgcccaatgagaaagggctggaattttatgaccgcctgtttgacgaatgcttaaaatacgggatagaaccgctggttaccatatcccattatgagactccgctggggctggcggaaaagtacgacggctggagaagccggaagctgataggatttttcgagcggtactgccgcaccattttcaccagatataaggataaggtgaagtactggctgacctttaacgagatcaattcccttcttcacgccccatttatgagcggggggattaagacgccggcggaacagctgacggaacaggatttgtaccaggccatgcaccacgagctggtagccagcgccatggctgtaaagctgggccatgagctgatgcccggtgcgaagatcggctgtatgattctgggaattacggtctatcccctgactcccgatccggacgatatcattgcgaccatggagaaagacagggaaacgctcctgttcgcagatattcacgcccgcggaacgtatccgaagtatctcttaaactattttaaggatcatggaattgagatccgtatggagccggaggatcaggaaatcctgaagaacacagtggatttcatctccttcagctactattccagcgtctgcgccaccacgcatacagagcttggcgagccaaccggcggcaacttgtcaaaggggtataagaatccgtatttaaaggcaaccgcctggggctggcagatcgatcccaagggtcttcgctacacgctgaaccgcctctatgacaggtatcagcttccgctgtttatcgtggaaaacggcatcggcgccgaggatcagctggtgactctggaaaatggggaaaagacggtgctcgacgactaccggatcgactacctgcggcagcatctgatccaggtgcgcgaagccatatgcgacggtgtggagatcatgggctatacctcctggggctgtatcgacctggtgagcgcctccacggccgagatgagaaaacggtacggctacatctacgtggaccggaatgatgacggcaccggaagcctgaagcggtaccgcaagaagtcgttctggtggtatcgggacgtgatcgcaggcaacggtgccagtttatagatcatagaatggtgatctggtctgctttatcagaggggctgtgaatcgaacttcttcccctcgtccagtatacactcggcaatcaggcgggagaatggctccatgtcgtactcttttctggaaatggtgagcgcctgctgatacgcttcccggcgttcggtaccgatggtgatggggcggtagccctcggaaaccagtatccggttcatgagaagaaacgcggtctcttcattggcgctggtaaagggctgaatatcgatcagccgtttgccggccatagccgccagctcaatgggatggagcgaggatttcgacgaacggatctgatcggctaaatggccggtcagcctcgggacgtcctccggatgtggcggctggtatccataatcatcaatggccggcataccggtacggtaggaatccgctggtgtcgtgccgccgcctgtcagtactgttctgtgaagctcttttatggtgtcttccgtaatggttatatcctgatggcggctggttttcaattgatccgcctgctgtaaaagttcctttaatggtgtcatgataaattcctccttcgtgtattataccacagagaaagaaaagggtgcaacgggggagcacaatgattccggtatggacaaaggaagaagtcctcccagccacggctgcgtctgaaagcgccatggctgggaggacttctttgatttctgtataatccgtttatctctgtcccttgtcgtaaggcacgccctccgccttcggagcctgggagttcttcgatgtgaataccagcacgatcaatgtgatgatatacggcaccatcttgtaaaaatagctgggtattccgaggctgcttaagaacggaattccggagtaggcggcggccactgccttcatcagtccgaagaacagggaggccagcatgattttcaccggtttccactggccgaagatcaggacggccaaagccaggaagccgtatccggcgacatcggcgttaaagttggtggaggtcggaacgacgaataccagtccgcctaagcctccgagagctcctgagatcaggacgcccgcgtactgcatatggtagacgttgatgcccgccgcgtcggccgcctggggatgctcgccgcaggagcgcaggcgcagtccaaaccgcgtcttgtagagcacgacggtggagagcacgaagattgcgataccgatgtaggtggtaatgtaggcgttctggaacagcagtggtccgataaacggtattctgccgagtatgggaaccgaggtgatccggaaggtattggtaaactgtacctgctgtacgccctgaatgacgcgggccacgaagatggcgaacgcgggggcgaacatgtttaaggcggtaccgctgataacctggttcgccttcatattgatggaggcgtatccatggaacagggagaagaacatgcccgtcgccatggagattaagactgccagaatcagctgcatctggccgctcatggtgcctcccgtgaaatggataaacaggatcccggtaaatgcgcccatggtcatgattccttccagcgcgatattgatgataccgctccgttccgagaacatagcgcccagagccacgatcataagaggaatcatgaaatacatggtctgctgaaagataaaataaataacactcatgcgtctcctccccctttcgtctgtgcctcttctttttcatggcgcgccttctgcacctttccgatcagcatctttaccatgagggcaaaggcgctgaagtagatgataaccgcgacaatgatatcaatgatttccgttgaaaattcaaacagctgcagataaaatccgcccgccgttaagtaagcgataaagatgccggagaacagcaccccgatcggattgcttaagcccagcagggcgacggagataccggtaaagccttcggaagccagaacatccttgatctcgatgtgctttccggttccggccagatagaggaggccgccggccagtccggcgatggcgccagcgatcatcatggacatgatgatgcttttcttctcattgatgccggcgtacttgctggcatcgcggttgaagccaaccgccttcagctcataaccgaaggtagtcttgtttaacagcaggtaaatcaggataacgacgataatggcgatgatgatgcctccgttgacgctggagccggggaaaatcttatccagtcccatcttcgggatatttgcggtagccgccacgtttctcgattcatttctcagattgttaaacaggggcttgctgctctttacggtccagttgacgagatacatgccgatgtagttcatcatgatggaggcgataacctcattgacgttatagtatgcctttaagaggccgggaacgagtccccacacggcgcccgtgacgacgctggccagcagcgccacaagccagtgcgccggccccagggaggtccacaggatccctacgtagacggctccgaagccgcccatgatgaactggcccggcgtcccgatgttgaagagtcccgtcttaaaggcgaaaccaacggagagaccggttaaaatgatgggggtcgcatagtagaatacctgtccgatgcccttggccccgtgagtaaatgcacccgtcaggatggttgcaaaccccggcagtgcctgggacggattacagagaaacaggatgatcaggccgacgatcagtcccagcacgatggcaaagatggaagacaggatgccattgtaatcccgcggttgtttctgtttcatgagttgccaccttctttcttcgaaccggccatgtaaaggcctaattcctgtactgtaaccttcttgggatctaaatcagccacaatggagccctcaaacatgacgagaatcctgtcgcttaagttcatgacctcgtccagctccagcgataccagcagaatcgcggctcccgcgtcacgctgcttgattaactccctgtggatatattcaatggcgcccacgtcgagacctctcgtgggctgtactgccagcagaatgtcgtgatctctggaaacctctctggccacgatcgccttctgctggttgccgccggacatgcttctggcgctggtgtaagccccctcactgcttcggatgtcgtaattttcaatcagcttatccgaatagtcgtagatgctgtcattctttaagaaggaatacttctggaagtccttctcaaagtactgctggagcaccaggttgtagcccagattatagtcaagcacaagtccgtgtttgtggcggtcctccgggatatgggagagaccgtgggtgtttttatagcggatgctctttttcgtcacatcctcgccgtttaacagtacggttccctcactcatctcggccagtccggtgatggcgtggatcagctctgtctggccgtttccgtcgataccggcgacacagacgatctcacccttccggacctggaaggtgacattgcttaccagattcttcgtgtggccctctttggtggccttgacggacagattctttacctccagcaccacgtccttgggggtggcggggcctttttccacggtcagattcaccttgcggcctaccatcatctcggacatttcctccggtgtggtgtcctttacctctacggttccgatatattttccacggcgcaggaccgtgcaccggtcggcaaccgccttgatttcgttaagcttatgcgtgataaagaggatggatttcccctccttcaccagatccctcatgatctgcatcagttcatcgatttcctgaggcgttaagacggccgtgggctcatcgaagatcatgatctcattgtcgcggtaaagcatcttcagaatctcgactctctgctgcatgccgaccgtgatgtcggagatgagcgcgtcgggatcgatggtgagctggtatttctcactcaaatccatgatttttttccgtgcgtcgtccattttcaaaaaaccgtgtttcgtggtctccatgccgaggacgatattctggagaaccgtaaaattatgtaccagtttgaaatgctgatgtaccatgccgatgcccagcgcgtttgcatccagcggcccggtaatcttttcttcttttcctctgactttaatgacgcccgcttccggctgatagaggccgaacagcacgctcatgagcgtcgatttccctgcgccgttttcgccgagaagggcgtgaatctcaccctttttcagctgcagagtgatgttgtcgttggcgatgatgccgggaaattccttcgtaatattcagcatctcgataatataatcatccatgagaacccccttgcagtgcaaaaaaggagatgccgtaagatacccgtcttcagttgtgactggggaatcaaacgacatctcctttcttatgtagactcgattattctacgaagttgatagttgtcttttcaagctttaagtccttggtcggatcgttgttgtcttcagacggctgtacgagagtgatcttgccatcctttaactgggcatagaccgcgtcgtaatctgcctgtgtgaatttcgtaaacttggaggtctccatcggaaggccgatgccgtcgttcttcgcggagaagatactggtcttgccgcccgggaagctgcctgcatagaaatctcttacgccgtcgtaaacagatacggaaagctgtttcatagcggaggtgaccacggtgtcggattcgtaactctggtcaacgtcaacgccgattaccttggcgctcttttcttctgctgccgccataacggagtttccaactgcgccgccgcatccgaagatgacttccgtgccgttctgataccaggatgcagccatggactgcgcttccggtgtcgcggcaaatgcgcctgtgtagttgtacataatctcgatgccgtccacgcccatctcattggccgcgtagtcagcgccttctgcaaagccgtagccgtaacggattacggccggaactgccataccgcctaagaatcccagcttggtatagccgtcttttactgccgcatagcctgcgaggaaaccaggctcatcttcctggaacagaatcggcatcacattggcttcggttctgtattccgagtagtcgccgctgtgaggctcgccatccagaagaatgaaatgtacgtccttgtactggtcctgtgccagataaacaggctcttcaaataagaatccagggcatacgaccagttttgcaccgccttcaattgccagaccgatggtctctaaataagagtccgtcgttccttcctgaggctggtagtacttgtaggaaataccgttttcttccgcgtatttcttcatgccttcccatgcgccctggttgaaggatttgtcgtcgatagtaccgaggtcggtaacaagagccagttcataaccatcggaagtttccgattttactgcggtatcggctgtcgtctcggcctctgtcgctttggcttcagcggcagtcgtcgtctcagcgggagcggctgtcgtgctgcccgaaccggaattcgaagaaccgcatgcgcttaaggatgcagccatcatgaccgccagtgttactgctaatgctctctttttcataatacgtaattcctcctatcgttttgaaagattgttattagagctaattctactttaccatattttggtaacagaaacaatgtaaagtagggcaattttacagaattattataaagtagcttgttatttaaagaaaaaatggtaaactgataaaggatttaaacagaaggaggaatattgtgcagaaactaaatctcttggaagagccggtacaaaagctgtttatcaagtatctgatgccatccatcagtgctacactggttacttctatttatattttggccgatacgctgatgatcggccggggcgtgggacctgtgggaatcgcggccttaaacctgctgcttcccttattcagcctgttctttggaacgggcatgctcttcggcgtcggaggcggcgttctcctctcaatctcgaagggacgccgggacgagcaggcggcaaaggagtattttacggtggcactctggctggccgtggcctttgcggtcttttacattgcaggcggtcacctgctttttaagcctgtgacggaatttctgggcagaaatgataccatgggcaattatgtcgacgagtacggccgcgttctggttacgggcgctccggtcttcctgttttcggcctttttacaggcatttgtcaggaacgacagggcgccgaaggtatccatggtggcggtcgtgtccggcggtgtgaccaatgtggtactggattatatttttatatttccaatgaaaatgggaatggccggagcagcgatcgcctcggtgatcggttccctcctgacggttggaatcctgctgacccatctttcctccccggacaacacgctgaaggtggtggcccgccccgagtggaagaaggcgtgggaggtcgtggtcaacggatttgccagcttcctgctggagatgtgcaacggcgtggtgacctttttattcaaccgccagctccttgtctacgtgggcgatttgggggtggtcgtgtacggaattatctccaacagcgcgctgatcgtggcgtccatcagcaacggcatctcccaggccgtacagccgatactcgccaccaattacggtgcgggcagaaagtccagattaaaagagacgcgccatatgggagagatagcggtgaccatatcgggcattctgtttacgggaatcggccttcttctgccggccctggtgaccgcggccttcgtgaagccgacggcggagatcctggccatgtcggttccggccgtgcggatctatttcctgtccttcttcgccatgggctttaatatcctgtacggcacctatttccagtccgtgatgaagccgggatactccctgttcatctgcatgatgagggggatggtgataaacggaattctcgtgttccttctgccggtcgctttcggcgttaccggaatctggtccgtcatgcctgtgacggaatttgtaacgctgatcatctgccggtttctgctggcaggccagaataaaaaactgccgtctaccggcgtgtccggtgcttaaagctgtctgtaaagagcagcttcagaaaaatattcttatagtcttctaatcgcagaaagctgtatatcccggctttctgcgcaattcggaacaaatccataacgagaaggtagtattcaaaataaaaatggaagcggctcatgcattccggtttgactaccagatgcatgaagtcccatttttcacagttctccgtggtcagtctgtcccggtattcgttaaacagcgccgtgcccggtatgggcgtgaaaatggagactcccgtataggtaatccggtgcgtgtggataaaacgccgcatattccggaaatcctctttcttgaaacggctgtcgatgatgaagagccccaccagatgaatgctgtatttttgaagcatccggatggtcttaatgttgagagactgggaggaatgcttctgataggagtccagaaagctgtcagaaaccgcctccaggccgaccatgatataacggaagccggcctccgccagttcccggatcaagtcctcatgaacggcgataaaatccgagcgtccgtagcagataaagttcttcttgatattccgctcccggagcagccgcataaattctttcagcctcggaacatcgtacaggaagtcgtcatcggcgatctggatattgccgcaggggatggtctccagctcctcgatgatcttttccaagtcccgctggcagtaggtgccgcagttgagctcccggccatagcagaaggcacagtggtagggacaggaagatgaggtctttaaaagggctacaggggagacgtctaagtagcggtagtggtcctgataggtggagaaggcacttcggtcggggattgggagtttgtttaaatcaaacggtttcatgggatttttgtgccagcccccattctccggataacaaagtccgtcaatcacagacagctttggcggacaaaaaccattttccggcggaatgagcccctccgccttcaatgcctccgcaaccgcatagatattgtcggaacggcatatgtaggacacggcgggatcgaagaaacgctccgggttcagctgggcatgggagccgccgatgatggtgacgcagccggggcgcagcgccttcgcacgccgggcgtaggagagcattaatttttcctgcgtgatatagccggtgacggccaccgcgtcgggggtgtattcattaaaaatttcatcaaagctgcgcctgtcgaaggaggcttcatagatcatgctttccacattatattccttcagcatggcttttatatactccagttccagcggctccgtcttaagagccatatccaggctgaagccgttgtctgcggcctccggttttaccagcagtatcataccatccctccttccaattgcgctgtcctctgatcaaattatatggtagaatagggaaaaaggcaagaaaggaactccgatggaatacatctatattcttctgctctacctcccctccggcttcggccgcctgacacagcgggcgacgggctaccagtacacccatgcggcggtgtcgctggacgatacgtacacccatttttatgcattttccaggctccgggcaaagacgcctcccatctccggatatattgaggagaagaggatctattatacgctgggggaggatgtgcccatttacacgaagattttccgggtgccagtcaccaaagagggataccggaacgctatccgatacatggaagacgtgaaaaatgatcccgagatcatgtacaatttaatccatatgcttctgatcccggtcttcggaggtcatccgctctataaggcgtttcactgcggcgagtttgtcgcgaaggttctggaggcggcgggaatcaaactccaacagccttattaccgttatacgccaaagctgttttccgaactgctggagccgtatttcttatacgagggaactctggataattccagccgcgacggaatggaggacgactttttccgggaaacgccgaaaaaggaataccttgcaaaaacgctgtatattataaaggaactgcttttccgccaggtctttcaccgcgcctccggacatttccgtcctgaaaaggtgcgttttcgtgtcacggacaaagtgtgagattatataagaggaagaaatgggatatctgataatagcagggacaagtcagataatgaaaaatcgtatatacgaacaaaaatcgcatatcagaaaatgacagaatttgaaagtactttcataaaattgtactgaaaaaagagcgaatttttgccggtaaatcaagaaaacctctttactagaaattgaattatgatataatattgacaggtcttttgcgcgttttttttattctggcgcgaaagcgaaccgataactttatttgaggaggaaatacttatggcaacaaaatgggtttatttgttcaaagaaggcagtgccgacatgaagaacctgttaggcggtaagggagctaacttagcggagatgactaatttaggtcttccgattccacagggctttactgtaacgacagaagcttgtacagactattataccagcggcaagaagattactgatgagattcagggacagatttttgacgctctgaagacattagaggaaattcagggtaaaaaattcggtgataccgaagatccgttattagtatctgtacgttccggcgcaagagcatccatgcctggtatgatggatacaatcttaaacctgggacttaacgacgttgcagtggaaggctttgccaagaagacaggcaacccaagatttgcatacgattcttacagaagatttatccagatgttctccgacgttgttatggagatgagcaagactttcttcgaaggcatccttgatgaagtaaaggaagctaagggcgctaagtacgatacagacttaactgccgatgatttaaaggaagttatcgcaaaatacaaatccatctacaaagagaaaatgggcgaagagttcccgcaggatccgaaggttcagttaatggaagctgttaaggctgttttccgttcctgggacaaccctcgtgcgatcgtttacagacgtatgaacgatattcctggcgactggggcaccgctgtcaacgtacaggccatggtattcggaaacatgggcaatacctccggtacaggcgttgcatttacacgtaacccatctactggtgagaacggcatctacggcgagtatttaatcaatgctcagggcgaggacgttgttgctggtatccgtacaccacagccgatcacaaagctggagcaggacttaccggaatgctacaaagaattcatggcaatcgctcataagctggaagaccattaccgcgatatgcaggatatggaattcacgatccaggaaggcaaattatacttcttacagacacgtaacggcaagagaactgctccggcagccatcaagattgcctgcgatttagtagacgaaggaaagatcacaccacaggaagcagttttaagaatcgaagcaaaatccctcgatcagttactgcatccgacattcgataccgctgcattaaaggcaggcgaagtaatcggttccgctcttccggcatctcctggtgctgcagctggtaaggtttacttcacagctgaggatgcaaaggctcatcatgaggcaggcgagagagttgttctcgttcgtcttgagacctcccctgaggatatcgaaggaatgcacgcagcagaaggtatcttaaccgttcgcggcggcatgacctctcacgcagcagttgttgcacgtggtatgggtaccgcttgtgtatccggctgcggcgagatcaagattgatgaagcagctaagtactttgaacttggcggacataccatcaaagaaggcgattacatctccttagacggttccacaggtaagatctaccttggcgatatcgctactgtagaagctaccgtaagcggtgacttcggcagaatcatgggatgggctgatgagttcagaacactccatgtaagaacaaacgcggatactcctgcggatacattaaacgcagtgaagttaggcgcagaaggtatcggcctctgccgtaccgagcatatgttcttcgaagaagacagaatcccgaagatcagaaagatgattctttccgatacggttgaagcaagagaagaagcattaaatgaactgattccgttccagaagggcgacttcaaggcgatgtacaaggctctggaaggcagaccaatgaccgttcgttacttagatccgccgttacatgagttccttccgacaaaggaagaggacatcgaagctttagctgctgatatgggaatcactgtagaagcaattaaagaaaaatgcgatggcttacatgaattcaacccaatgatgggccacagaggctgccgtctggcagttacttatcctgagattgccaagatgcagacaagagccgttatggaagctgcaatcgaagtaaaggcagaagaaggatacgacatcattcctgagatcatgatcccactcgtaggcgagaagaaggaattaaagtttgtaaaagatatcgtagttgagactgcagaagcagttaaggcagaaaaaggctctgacatccagtaccacatcggtaccatgatcgagatcccgagagctgcattaacagcagacgctgttgcagaagaagcagaattcttctccttcggtaccaacgacttaacacagatgacattcggattctcccgtgatgacgctggcaagttcttagattcctactacaaggctaagatctacgagtctgatccatttgcaagacttgaccagaccggtgttggacagcttgtagctatggctgctgaaaagggcagaaagacaagacctgacatcaagcttggtatctgcggcgagcatggcggcgatccgtcctccatcgagttctgccacaaggtaggcttaaactacgtatcctgttctccattccgtgtgccgatcgcaagactggctgcggctcaggcggctctgaacaataaatagtgaccgtttgttcggtgaaaaaccatacttgattttgcaagtaatgtttgatataatggtagcaggcaaaagagagaagttctagatgtatgtacaaagcgaaaaccccaggagtaccagtcctggggttttcattaggctaattgtcgcgattatcttctatctagccatttgcaaatgaagtaggcaacgacacttgctgtgatagagagaataaaagagaaaagttccattatgtaagcacccccttcctgttgccagaatgggtgcgacaacaaataagcagttaagtattggtgtttgatacaggaaattaatatggacgagttatttgatattttatcaaatagctcgttttattgtgcgtgattaacagtagaatacgagaaattccgattgttgaatattaaataaatttaggttctgaataaaagtgaaaacatcagaggcgctgatctgaggttttcttttaataccgttttaaatttgaaacatatccgtatgatacttaagatcaggaacaggtataaaatcatagagaaagttcgaaagatgttaccgtaacaagttaaatgtatggtaaatagtggaaaatatatttgcttacagggagcaaaataacggaaaagctgcctgaaaccatggaaataccgaaggatgaaggcccatggcataccttttcggcgattggaccgggattctggggactgtgttggcggttgtgtaataccatttgatcgagtataatagtttagaagaagcagtatgacaaatgaggcagcgatgccggaaaacgggggataaagaggatgaggagaagaggggcaaggcgtttggtattgagatatggaatcgttggtcttttggctgcggggctgctttccgggtgctccggcacgggggaactggaggctcagaaccaggagctgaagtcgcaggtggagagcctgtcagcggtaaaggagagtctcgaaggcgagaaggaaagcctttcctccgaactggcatcggcgaaggagcagaaggaagaggccgggaagaaagccgcggcgctgcaggcgacgatcgatgagatggctaaggaagcggaaatccaggatggggatgtcgtcgtcagactgattgggaaagaggatgtggagaaagactcctccaaatggatctttaacagctacagcaatttgaagtttgagattacaaacaatacggacaaagatatacagggaatcgagggaaaattaaagatcatggatctgttcggcaaagagattttaacagccggatgtgattttaccggacataccataccggcgggggagactgtggtcaacgatgatctgagctttgaaatcaatgagtttatcgacgagcatatgaagctgtatacgacagcgtatgaagacttaaaatcagagtatacggtgacacagatcgtatttacagacgggacagtaaaggaataggtgagcagccacactggtgtctgcgcgattacatagaaaacctcgggctggtcctgaggtttttcgctgtctgcataaattacggcaaaaaaatggtcattcgcggtcagatcatacggcccgggccggaaaagactataataaaaccatcaaatgacccggaaaggaatgacagtttatgtatgaactcagagaaaagaaagaagaaggaacgaagaaacccgtatggaagaaggcggcggcatgtattctggcgctgttgttattttttgcctgctccgcgctgctttatgtgacgaagctggcgacatccacacagaaaatcccggatgcggacatcaaggcgatcagcaatgattatctgaatgaagcgacggagaagcagatggacgattactggacagtggctattttcggcgtggacagccgcaacggcaacattggaaaaggaaccagcgcggacacgcagatgcttctcacacttaaccgcgcaaatggagaaatccggctggtatccgtttaccgcgatacgctgctgatgagcaatgtgaaggaaggaaagtgccggaagataaactccagttatacggaaggggggccggagcaggccgtcacggcattaaatgaaaacctggatttgaaaatcggggattacgtttccttttcctggaaggcggctgccgacgcggtcaacctgctggggggaatcgatatggagatcacaaaggcggagtatgcgtatatcaatgcctttatcacagaaaccgtggatagtacgggaatcccttcggtacatttaacgggcccggggccggttcatctcgatggagtccaggccgtcgcctacagccggctgcgtctgatggacaccgatatgaaccggacggagagacagcggaaggtgatcgaggccgtattggagaagctgaagcaggcggatcttccgacgatcaaccgtcttctggagacggtgctgccacaggttgcaaccagcatagacgcaggcgactttctggaactgggaaagaacgccggaaattaccatattgtaaaaaccgaaggctttccgaccgtatacaaggcggccacgcttggaaagctgggaagctgtctgattcccaacacgctggaatccaatgtgacggcgcttcatgaattcctatacgaagatcaggactatcagaactcagaccgggtgaaagagatcgggggagaaattattaaacaggcattgggagagtgaggtgacactatgattcggatagcagtttgtgatgatgagcctgcgtttgcggagcgggtgaagacgctcattgaagcagagtgccgcgcgctttccgtttcgtcggagacggttatctataccgacagcggcatgctggcctatgacatcggggagaagcggtatttcgatatgcttttcctcgatattgagatgcctggtttctccggcatggaactggcggatttaataaaggattcgctgccccaggcgcttgtctcctttataacctcccatacaaagtacgcggtcaagtcctttgagctctccatcttccgctatataccgaaggcggaggtggaaagctgcttatccatggcggtttcggatgggatccggctgctttcctggaaggtgaaggagtgttacgtggtggaaacaccgcgccagatcatgaaggtggcgatgagcgacattctctatatctataaaaaacagaaatactcttgtctggttctgcctggggaggaggtgccggtccgaaaggcgctgggacaggtaaaagaggagcttggcagagaggagttcctgacgattgagaggggctacatgattaacctttaccatgtcagaaaaatggaaggcacatccgtggttatggacgatgggactgtgctgccggtgagtcagagccatgtaaaagaagtgagagagaccattaccggtttcttccggaggcatctatgaataccatatttcagctttgtgaacttgcggcctattttttggaggcattgatctgctatttttttattcagctgtttttccctgagaaagcgaaggggaaactcagctttttcctgttgtccggtgttctgcttctgacgctgcagcttgcggattctctccatgtgtatccatttctggttaccctgtggtttgtcttttatatctgtatgacgacggttctcattttccacgtggatgtgttttatgccgtctccctggtgagcttctatattctgtgtgtctatattattgatttcttctgtatttcggtgatgggggtatttttgaagaaccagcagttcgcacagatggtcatcgcacagctgtcgcagtggcgtctggtgtatcaggctgcggacaagctgctgctgaccggggcgtattttctggcgaggaaagcatttcgccgggagctggcctataatccccggatgatgttcctgacctcggggctggggctgtgcggcgtcggatttctgtcatggctcacgattcaggagacgagccttcatgcgctgttcggatggagcatgtgcattatcttgctgtttctcatctattttcttctgttattttactcgaaatacgtgggagagcagaagcagcgcctcgccctggaaatgaaggagcagatgatcgacagggagtacgatctgatggtccggcagcagcaggagcaggaagagctgtcgcatgacatgaaaaatcatttgcttgtgctctcttccatgatcggagaggggaaaatgacagaggcggaaacgtatctggagcgaatgggagagcctctgcgccagctggagatgatggtgtggacgggcaatccggtgctggatgtgctgttgaacaatgccagaaacagcgcggcaaagaaaaaaatccgctttaccattcaggcggatgcgctgacgctgggagatatggaagaccgggagacgtgcagcctgttttccaatcttctggacaacgccgtggaggcagtagaccgggtggaggagggagatcgctggattaccgttaaaatgcgaaaggcgggagacatgatattcatcgaactctccaactccatgaccggcaggccctccgtcaaggacaaccgcctggtgacgacgaaacgggagggaaccggccatgggctgggacttaagagcgcggagcgcgtggtggaaaagtacggcggcagtctggtctgcgaatacggagacggtgtttttacggttctggtgtccttcctggaagggctgcgagacctctcataatccggccgtcatcccagaaggcgccgtggccgccgagacggattgcaggcttgtgtctgccgtgaaagtcactgccgcaggtgataagaagtcggtttttctcagcgacctccacgtaataggccgctgcctcctcatcgtgataggaggaaaatgcctcgattccgtcaatttcgcgaaagagcagactctccagcagctcggtttcgccgcggtcgagattctgaccggggtgggccaggacgctgattcctccggcatcgtggatcagagacacggcgtcggcaagggaaatgtagtggaccggtacataggcggccttaccttctgagaagaaatcccaataaaaccgcacatttggcatgtcgctttttgctccgcccggaagatatgggcggagtatttcatattgcggggcttcttttttggcgaggagaatatccgcgatcaattcgcctggaacgacgccgtcgctggaggccgccaggacctcatcctcatcgaccgggattcctgtggcgctctgaaataatcggattttctctctggccgccattttctcctgctccagaatatcctgttcaatctgcgcgaactcctttcgcgtatggtcgaagcagtatccaagcaggtggaagttcctgcctttatgggtgcagtccagctcgactccggagatgacgcgaaggccggaggcggcacaggccgaaagggcttctgactgggccgcggcgacgctgcggactgagttgtgatccgttatggcgattaactccatgccctgtgccctggacattgcaacgatttcctgcggtgtgtattctccgtcatcactggcggctgaatggatgtgtaaatcaagctttgacattgaagatctcccttctgtttctttgatggatgtattatctggtatggctgggactctgtgaaggataaaaccagggcggtttaatgtttctgcgattcccgaattttctgccgcctgcggaaataaaagtaagtaaactgcaggagaagaattcctgcggttgaaatcaggtagagcacccggataccggtaaatgcggcggaaccggccgctgcagaaccggccgctgcggtgcgggcgtcgatcaatcctttgactgcgcctccggtcagcgggccgaggatggagccgaaaccgatggctgccgtataaaaattatcatagacaatccggttatccgctggcatcagttcgtatctgcggttaaatacggagatcacaaatccggcgttggcggccgaggatatgagaaacgcggccggaataaaaaggtaccagttctgagcgttggcgaaggacatgaacagagtctcacctgcaaagaaccagatggacatttttaaggtgaattcatggccgcagcggtcgcttaaccttccccagaaactgagcagaacgatctgcggcagagagatgatcatgtatagtccggtcacgatctgataggggagcgccagatatttcatcatgtaaaccatggtatagctgtcggaaatggtaagcagcaggtaaaagataaagatgtaagccacaaagcctgtaaagcatcggtttttgagaggcagtccggcgatgttccggaagcggcagcctctgctggaggactggtacggttccccgtcgggtgttcctgccaggagaatcacttcaaagattcccatcagggctgcagcggcaaacaggatggcgaaaccgatgtattttcctcccatgagatccataaaacggccgccagccagcgacagaaccactgtgaccgtgagcgtcagcgtctgtcttagggaaatgtaccggccgctccttttttcatcgataaaccccagcatccactggttcagcaccactgtcgtctgggcctgaagtgcgaaggcagcgacaacggtgggaacgaatacgtaaagctgcattctggctggaaacagaaccggtatggtgacgaggaaaagtgttgccaggcgggagaggatcgtgagtgctaccgtcatccttttgcggctggtgaatcgctccagaaatgccgggaatatgaggatcagcacaccgcagatattgacgataacgcttaaataactgaccagaatgtcaccggctcccataagaattgctaggccgcttaagaaaacgccgctggtcagatacgtgaacgctgtgccgaatccggcttggacgagaaagcaggtacggggacgggagtccggcaggccctccccccccgggctggggtttcatggctgctcctttataaactgaacgtcgtcaaagattttcccggctgttaagtacgccatgccgtcgtgatagtcgtgccagagatcggccgaatacagaatctccgcggacatgtgtctcggaagaagagcggagaagccgtcgctgatgggaccgatacagcctttgcgcagatcggggccgcccaggacgacatactggggatttaaaatgccgcagatccagccgatgatacggatcatcagattggtgtaagctttgtcatccactgcttccatcagccactcgtcgagaatccggccatcctccatgggaaccagtcccagctccccggcaaaattgcgaaagccgcggacgacccgcccgccgacgatgaaaccggcgctgacacacgttttttccaggtgaagatacgccatattcgtgagatccggggcctcgcagggaaattccctggcatagcagcggccgaagccgatggcggtggcatttaagtcattctccataacaatgggaatgtgataccgcccggcgaggcggtctcctaagtcatggcggcataattcgtcgctgctgccgctccctttccagaacgaaccgtcttcgacgatgcccggaacgccgattccgatggacttgatatcctttcgcgccatgagttcatcgaggtatgcggtgatggccggctcgtagtcgtcgcccgtaaactccagtctgcaagtctctaaaatctctccacagattcctacaagcagcccgtgcatctcactgcccgagatgcagatcgctgcgccgtagtacttatccggcttaaagcggtaccgttccgcctttcgtccaccgctggattcgtcgtgtccaatgctttcgatttccccgttttccatcatctcggccaggagagagcggaccgtcgtagagctgatctgcgtctcaccggcgatttccgccctggtcgcagtgcctctgcttttgatcactctgcggatcagcgaaagattcgcctgttttaaaagccgtggtctggcggttaatgtatccataagaacgcctccttgaaacttttgttgggaacttttataagtttataataaaagtatatgcgggaacgaaagaactgtcaatagagaaaaaatatttttctctgttgacagttctggagatcagtaaaatactgaggttatttttctaaatttcaatcactttccccttggaaagtctcgactcctccgccgcaaacgcgacgaggtggctgcctacggactgctccagcgaggtgatcccctccggctcttttccggtctgaagcatgtcgaggaattcttccagcatgcggttgtcgccgccggcgtgtccgctgaaatcctcggccagctgggagatgtcgatgatctgacgcggttttccaaagagaccgatctcgatagtgtttttgtacatgtcaccggtgagatcgcctttggtgcccatgatcttgcagtatcgggaagcaccgtcgctggtaaagccgctcatggtgaaattaatggtgctcccgtcggtgttttcgatgttggtcacctgatggtccaccacgttgttgtcacaatggtagacacagcggccgtaggggcctgtctttatggcttcgtagatcgtgtccgtcgtcggatggagggctaaaatgtccaccggccattcggtgtggccgcaggcgattccggtcttttcgtcggtaacgtagattttttccgcgtcgaagggacaggagtctttggcggcacagccgtcgaggcagcgatgcgcagcgccttccggggcacaggattccttgaataaataggtgctgcccatggacgtaacgcggagcggcgtcttgtccgccagccataagtagaggtcgaaatcgtggcacgtcttctgaaggcacatgggactggtcgtctcgctgtttctccagtttccgcggacaaagctgtgtgcctgatgccagtagcccacgttctcgatggcctggatggtgacgacgtcaccgatgatgccggaagcaatcagttccttcatcttcgagaaaaatggcgtatagcggagcacgtgacagacaacgattttccggtcgtattttttcgacgcttccaggagctgacggcactcagagggatcgggggagatgggtttttccatcaaaatgtggtatcctctttccagagcggtaagcgcttgggagacgtgatcgcggtcctgggtacagataaagacggcatcggccatcttgggctgggccagcagctcctccgcactggcaaagcagcgctcctctggaatgtggtacgtctcggcggtctcccgaagagcgccgggatcgatatccgcggctgcggtaatctccattttgtccgggtgaagcgaggcaaatggcgcataggtgattcttccccggcttccaaggccgacgatggctacggttgttttcatgtgaattcctcctgttttatgataaattgtttgtatgaatacgcatggttacggtggtacggcggcttcccggttctgactcgatggtgagctccgacgacttttcaaaatagagcttgatccgcttatagaggttggccaggccgtagctccccgagactgagcctaccggattcgtatttttaaaggattcctggatccgctccatggtctcctgatcgatgccggggccgttgtcggtgacagatatgacacagccatcgccattttccacaatgcgaatgacgatgtgaaccggtgaagaggtggtttctaccgcgtatttcatggaattttctactaatgggtgaataagcagcttgggaatctgtatggagcgcacctccggctccacctggtattcccaggtcagacggtccccgaaccggaacttctccacctgcaagtactgttccacgaaggtcagctcctgatcgatggtgatgcggtcgctcccctttaaaatgtactggaacagcttggccatggccatgagaattccggcgttgtccatgtcatttttctggatcaggctccagtagaccgattccagggcattgatgatgaaatgagggttgacctgggactgcagcgcggtgatttccgctttggtccgcaaaatctctttttcaaatacctgctcgatcagacggttgttcttttccaccagagcattgtaatggatgttcagttcgttgatgtcggaattggagtaatgccggtcgttggcctgcagctttccatcggcaatcaccatggactttctcatgtccgacaatggctttgagatcatgcgcgcaatgaagagactgcagatcaggaatacgccggtcccgatgagaaagccgtagatcacgatgccgctcatccaggagatatcattggaggtcagttccttcggaatatagatggaaaatgtccagccggagtacgaggaagtggaatcggccagctggtaattccgttcgaaggcttccgggttcatgtcctttagcgtctttccataggaaacacgggcgccggcgcagtcggtcagctccagcgtgcagtcgcccagcgcgtttaaatcctgggcgatggagtccatcaaatccggcttcaaatgaaccacgacgtatccgccgtgttcaaaggcgtagtccgccaggagaatccgcttgaccgccatgatggtatggccccctccggactccgattcggacagcagccatacggcctttccgttgtattcgtcggccagggcgagggcagtctccgggatagcggcagagagcggctccttggtgtaaggatagatctgggcctttttactgtagagttcgatggattctaagttgtccgcgtaattgatcgtattcatggtctttaaccggagagtggaaaaactctccgaggaaaatgacgcgttctgattatagtcgtttaaaatggtctgaaccgccaggtcgttgcagagacgctgaagagatgaatccatctcggtcagcgaggagttaaaacgctcctgagcctgcttgactgtgatttctatatatttggaagactgctgaaggatgtagccggacatatttttatataagtaaccgccgatgcagagaaaggcgatggccatcaccagcatggaggagatgaagatctgccccgacgtggtgtttcccattaatttcagtttctgtttcatggcacctccggttgcgtatggaccatcgtatgtttgtgttacagcatcatcataccaaattcatatggtaaaatcaaaagatatgcatcaagaagaaaaaatagtggaattttacaaaaaaatagtgtggtttctttctttgttgtctattatatactaaatgtatcttataaaggagggatttacagatgaaaaaaagattagcagcaatcgtctgtgcagccgcgctgggggttacagcactcactggctgtgcatcaggaaagcaggagactacggcagcaggtacggagacgaccgcagcggcggccacggagaaggcggcaggcgaggagagtaaggcggagacgaccggggaaacagcggccagccaggaagccgcggagattacatactgggatacggtcggcagcgtgtcggaccgtgaggccaagctggccatgatcgggcggttcgaagcacagaatccgggaatcacggtaaaatatgagggaatggaaggcgaggcctacaagactaagattaagactgtggtaagcgccaacaatctgccggatatcttcggatactgggtgggagagcagtttaagacgcttgtaaactccggaaatgtggaagatttgtcttccgtttttgaggcggacacggcatttcgcgatacctttgtgccgggcagcttagacgcggtatcctatgacggcaaggtctacggcgcgccgacctccattacctgtatggcagtctggtacaacaaggccatcttcgaggagaacggagtggaagtgccgaagacatatgaggacttaaagggcgtgatcaacacactgtccgataagggcgtgacaccgatcatcgtgggagccaaggaccgctggccgcttctcggctggtattcctacctggcacagagaatcggcggtgtcgatctgtacaatgaggtgtgctccggagataagaatttcacggaagacgcatatgtacaggctggcgaggaaatcaaggctctggcgaaaaagggctttatcaatggctgcatgtccgtagacgctacgacggcggaagccttgttcgcggcaggcaagggcgcaatcttaattaccggttcctggtcgattccgacctttacggaagacccggagcgcgcaaaggatttctcctatttcccattccctgtggcagagggcggaaaagaggacgaggccggctacttatacggcggcgttgccaataccctggcaatcagcaggtcaacgaagaataaagacgcggttgtgaagttcttaaagtatatgatgagtgaggaagagcagaccttaagcgtagagcgcacaggaaccttctcgaccgtgaaggtatccccgaaggaagagaacatggatccgctggcataccagttcagccagtacgtatccgacggtgtggaaggcttcattccgtatacggatcaggccctgcctccggaacaggcggagaacttattaaatgctttaaccgctatcgttgcggaagacaacgccgacgtcaaggcggagcttgcaaagatcaaatagatttcactaattggtacaacattggggccgcgcacggaacacctccgaatacgcggccccgaaaggaataggtgcagagtatgaaaaaaatacatcctgcggtgcggtgcctcttcatattgcctgcggtcctgtggttttttgcggcggtgatcgtaccggtcctgatggcggtctattacagcttcttcagctgggacggggtgactgccaaggtgtttatccgcttcgataattacagggaactgtttaaggatccggtcgtctggaagtcccttaccaattccctgaagatggcattctggtgcgttctgcttcagctgcccatcggcatggcgttttccgtcattctttttaaccggaagctgaagggacggggatttttccggaccgtgtacttccttccggtggtgctgtcctcctccatgatcggtatcttatggggacagatctacgatcccaacttcggactgttaaacggtcttctggaggcggtgggattaaaacagctgcagcagatctggctgggggacatgaagctggcgctgggatgtattatagcggtggtggtctggcagtttatcggcaattatattctgatctactatacggccctgcataatatttccgaggatgtgctggagtcggccaggctggatggagccggtgtcctaaagctgttccgttatattgaactgcctctgatgtggccggtgatccgtctgaccctgatactggccacggtcaactccttaaaatactttgacttagtctacatcatgtcaaacggaggaccgaaccacgccagcgaggttctggcttcctatgtggtaaagaatgcgttcaattccatgaggatcggctatgcgaacacggtggcggtgcttctgctggttctgggaatcttctttattgttctctataacaaaatactggctccgtcatcggccagcgattaaatatcaccgaaggaggtttcctaatgaataaacgcagtatatcaccaggcaaatggattctgtacctcattctggcgattcaggcggcagtcaccacgtacccgctgatctggatgatcgtgtcctctttaaaggacaacgtatccttttttgcagatccgtggtccatacccaagaatccccagtttgtcaattacgtgacggcctggaaagaaggaatccaggactatatgataaacagcattgtgatcaccatcgcaacgctttttatcgtcattattctaagctgtgcgttctccttcatggtcgcccgttttccgtttaaggggggcggacttctggttggaatgttttttgcaggcatgatgattccggttcactgtactctcgttcctctatacagtatgatgaacggactgggatggctggacagcttatgggccctgctctttccctatgtggcgtcgggactgccgctggccatcttcctgacttacggccactaccagcagattcccatggaactggaggaggcggcgagaatggatggatgcggtgtcatccggatgtttctctacatctttctgccgctggccaagccggtgatttccaccatcgggatcctgacggccatcagcgtgtggaacgagttcatatttgccaatatcatcatctctgacccgcttaagaagacgctgccggtaggccttctggcgttaaagggaacgtacaatacgaactacgctgcggtcagtgcggcgttgactatttccgcgataccgattatcatagtctatatcctgatgtcaggaaagattcaggctggtatggtctcgggcgcggtgaagagctgaacgggggaatacgatgaaaaattatattgttaatccggttttacccggatttcatccggatccatccatcattcgggtgggggcggattactatatggccgtatccacgtttgagtggtttccgggtgtctgtatctaccattccacagatttacagaactgggagctggcggccaggcctctggaccgtgtctcccagctggacatgaagggcaatgatgcctccggcggagtgtttgccccctgcctttcctatgacaacggcgtgttctacctggtttacaccaatgtgaggacacactggtacgaatttatggactgccacaattatctggtaacggccgcggatatccggggagagtggtcggaacccgtctatctgcacagcctgggctttgatccgtcgctgtttcacgatgatgacgggagaaaatgggtggtcagcattgtgaggcattaccggaagatgcgcgttcagaagatcgccctgcaggaatacgaccctgttttaaagaaaatgacggggccgctgacggagatcttcgggggcagcgggctgacggctccggaaggacctcacctctaccggaaggatggcttttactatatcatgactgcggaaggcgggacggaatatggccacgcggtcaccatgggccggtcggagaagatcggcggtccctacgagctgtcgccctataatccggttttaacgtcgcggaatgatctgacacttcccttacagaaggccgggcacgctgatctcgtggaggcgccggacggggagtggtatatggtgcatttatgcggccggccgctgccgccgtttcgccggtgcattctcgggagagagacggcggtccagcatgtgagatggacagaggacggatggctctgtcttgcagacgggggaaaggaaccgcgtgtacgcgttccggtatcgtggccggtggaacggaaactagaggaggagatccggtatttgtttcagggaccggatttaagcccggatttcttttcactccgagtgcccctgggggaggctttatcactcacagaacgtccgggctggctgcggctgacgggaaaggattcgcccaattccaggtttgaacagagcctggttgcgcggagacaggaggacttcgcgttcagctttgagaccgaactggattttgaaccatcctcggagcggcagatggcgggaattctgtatttttatgacgagtgtgatttttactaccttcgtgtgacctgcggacagagcggacagaagatcctcgatgtgatgcggatgaaccggggaaagacggagtatgtgcctgactgcggtattgcggtgccggaggggcgtagcatccggcttaagctggtggtgcgccggacagaggcttcctgctactacagcctggaggagggggtgtggcagcaggcgggaaatacgctggatgcctcgctgctgtctgacgagtatccggaggaaggggcttacacgggagccatggttggcctgggatgccatgacatggcgtaccgcagcgccagggcgtatttcaagtatgcagtgtaccgcagagaagggaccggaatgggaacagactgataaagacggacggagaaggggggaaaccatggaacggacctatacactaatgctggtagaggatgagcggaatattctgtatggcatgaagaatgccatcctttgctataagccccaggtttctgatattatgaccgctgaaaatggccgggaggcgctggagcttctggaggaacgggttccggatattatcattacggatatccgcatgccggaggtagacggtaccgagctggttcgccggattcgtgaacaggggtatgagatgcctgtgattattctgacggccatgacagactttgccatagccagggatttgatccattaccagattcagaattacatcgtgaagccattttcgattgaggagatattaaaggagacggagctggccatcggagagctgaagaagcgcagccagatgaagatggcgcagaagatcgtgaaggagttcccggaactggtggaaactccgccctccagcgaaaaccagctgatatcccaggccgtggaatacataagcagccacttggacggcgcggcctctttaaatgacatttcaggggcgctccatgtgagcaaggcgtatctgtccacgctgtttaagcgggagatgaatacgaccgtgacggattttgtgacgaagcagcggatgaaggaggcgaaaaagcttcttctggagaccgatatgctggtatcagagatctatttgaaggtgggctaccagagcgataagtactttatcaaggtgtttaaggagatggagggggtgacgcctctggcctaccggaaacggtggaaatgaaaatcactatcagatttgtcttatttgcgcggctgattctggaagattgtaaaaaaaataacaaaagaaatgaaatggattattgactatttcgattatttgtaataaagtaagtattagcctatggcgtgtaacttacaaggtataggtaatatcaaataaactatttggttactatacactaatacagaaaagagaggttgaataaaatggcagaaatcgatttaagtcagtatggtatcaacggaacaacagaaatcgtctacaacccttcatttgaaacattatttgaagaagagacgaaaccagaactggaaggctatgaaaaaggccaggtaagtgaacttggtgcagttaatgttatgacgggtatttatacaggacgttcacctaaagataagtacattgtcatggatgagaattcaaaggacactgtatggtggacttctgatgaatataagaatgataatcacccggccagccaggaagcctgggatacagtaaagaaaattgcgcaggaagagctttccggcaagagacttttcgttgtagacgcattctgcggagcgaataaagatacccgtatggcaatccgtttcatcgttgaggttgcatggcaggctcatttcgtaaagaacatgttcatccagcctacagcagaagaacttgagaactttacaccggatttcgttgtatacaatgcttccaaagcaaaagtagaaaattacaaagagttaggtctgaactctgagacaacttccatgttcaatatcaccagccgcgagcaggtaatcgtaaatacatggtacggcggagagatgaagaagggtatgttctccatgatgaactactatctgccgttaaagggcattgcttccatgcactgttctgccaatacagatttaaacggcgagaataccgctatcttcttcggactttccggaacaggcaagaccacactttccacagacccgaagcgtctcctgatcggtgatgacgagcacggctgggatgacaacggcgtattcaacttcgaaggcggctgctacgctaaggttatcaacctggataaagaatccgagccggatatctacaatgcaattaagcgcaacgctctgttagagaacgttacccttgattctgaaggcaagattgatttcgacgataagagcgtgacagagaatacacgtgtatcctacccgatcgaccatatcgagaagatcgttcgcccggtttccgcagctcctgcagcaaaagatgtaatcttcctgtcagcagatgcgttcggcgtacttcctccagtatcgatcctgacaccagagcagactcagtattacttcctgtctggatttacagcaaagcttgctggtacagagcgtggaattacagagcctacacctaccttctccgcttgcttcggccaggctttcttagagctgcacccgacaaagtatgcagaggagcttgttaagaagatggagaagagcggcgcaaaggcttaccttgtcaacaccggatggaacggtaccggcaagcgtatctctatcaaggatacccgcggcatcatcgacgcgatcctggatggttctattgcaaacgcaccgacaaagcagcttccgtacttcaactttgagattccgacagagcttccgggcgtagatcctaagatccttgatcctcgcgatacatatgctgaagtttccgagtgggagacaaaggcaaaagatctgtctcagcgtttcattaagaactttgcaaaatatgaggggaatgaagcaggaaaagctttagtttccgcaggtcctcagttataagaataagatgtgtcagattggcccccggcagttgctgccgggggcttttttcgctgccttactttttaagggcttgcgtatcagagcgtgtttgatgtaacaaaaacatacaggttgcataaaaatcatttcacaaatgctccgaaaagaataggattgctgtcagaatttacaaaaaaaatagaatctattgatttaaacgtttaaatgagttataatgtgcccataggaaaatagtagttatgggataacagaagtttcattggaagcagataatgcagcatatttatgaggaggtcgcgaattgaaatcttatgaagcaatggaagaagaagctctggcagtgcgcagagacattgttgaaatgctttaccgggcgggaagcggtcatcccggcggatccctgtcggtgacggatattctggtgtgtctttacaaccggatccgcgtggatgcagagcatccggacatggaggaccgggaccgggtggtgctcagtaagggacatgcagcccctgcgctgtatgccgtgctcgcggaacacggctttttttcaaaggaagtgtttaaacgtttaagaagactaggcggaatgctccaggggcatccggatatgaataagacgccgggggtcgatgtctgcaccgggtctctggggcttggggtatcgaccgcatgcgggatagcactggccgggaaggtgagaaagaaagactaccgcgtgtatgcggtcctgggagacggggagctgcaggagggcatcgtgtgggaagccatggcggcagcggttcaccataagctggataacttgacggtgattgtggatttaaacgggcttcagatcgatggtccggtggaaaaagtaatgggctccggcaacttaaagggaaaatttctggattacggttttaaagtggcagaggtggacggccatgattttgaggctctggacgcggccatcgcgcttagggcggacagcgttccggtctgcattctggcgaagacagtaaagggaaaaggcgtttccttcatggaaaatcaggccggatggcatggacagaagatcagcggagatgactataagtcagcaatggaagatttgaaaggaggaagatgagatggctgaaccagcaatgagagaggcttatggagacgccctgttaaagatgggagaggacgaacgcgtagtggttctggacgcagatttggcgaaggccacttcctcctgtaaatttgccgccaggtatccggagcggtttttcgatatgggaatcgcggagcagaatctgatgggaacggcggcggggatggcgatcagcgggctgaagccatttgcatcgaccttcgctttgtttgcggcaggacgcgcctatgagccgatccgcaatgcagtctgttacgcaaaggctccggtgaagattgtggctacccacgcgggactttcaccgaattccgacggaggaagccatgagacgatcgaggatatcgcgctgatgcgggtgctcccgggaatgacggttttaagtccctgtgattacagacaggcgtttgacatggttttacagatgaaagagatggatcacccggtctatatccggatgtcgagacacccggtggagacggtgacggcggaaggaagccgcacagagatcggtaagatcgacgtgctccgcgagggcggggacgtgtgtttcgcagccacgggcattatgacagcagaagcgctgcatgcggcggagatcctggagactaaaggaatacacgcagcggtgttaaatgtacataccatcaagcctctggataaagagactctgatccgttacggaaaatcctgcaaacggatggtaacggcggaggagcactcggtaatcggcggtttaggatcagcggtggcggaggttctcgccgaaagcggcggatgccgtttgaaacgcgtcggcatccaggatcgattcggacagtccggcgatctggctgaactgatggaatgctatgggctgacagcgggaaatctggtggagaccgctttgaaaataatggaggaagacgtatgagaaagatcccggtaattatagactgcgatacaggaatcgacgatatgatatccttcgccgtgacactcacctcagacaagttaaatattctggggatcaccacggcggctggaaatcaggtggtggatatcaccacacagaacacattgaacggagtggccatcatgggaagatgcggcattccggtggcgaggggagcggaaaagccactctcgagaccgcttcgggatgccggttacatacacggtgaaaatggcctggggacgtaccagttttctgaaatgacatcgaaacagccggaagatattgatgcagtggagctgatgagaagcctgctggccgcgtcggaggaaaaggtcgtgcttctcgcaattgctccgctgaccaatgtagccagactgctgatggaacacccggaggcgggagcgaagatcgagaagatcgtgtttatgggaggctctctgcggaccggcaatccgacaccggtttccaccttcaacgtgctggccgatccggaagccgcaagatatgtgatgaagagcggtgttcccttccatatgtgccctctggatacgacgagagatttatatttgaccatggacgatatcgaattcatcggaacgatccggaatccggttgctcagatgaattacgagatgtgccgtttttacaacgatgctgtaaataagaacaacaacgcggccaggcgttttaaggggctgtgtatccacgatctctgcgcggctgcgtatgtgacgaatcctgagctttttactactgtgaaataccagggggatgtggagacagagggagaactgactctgggatttacggttctggattatgagaatatcagacaggtgccggaggaagagagaaatgtaacctttatcaattccgtggaccgggacggcgttctgaagatctatttcgaggctctgaaaagctttggagaacagggggaagagataaatggataaaataccggtaatcatagactgcgatactggaattgacgatatgatatcttttgtattgacactcgcgtcaaaacagctggatatccggggagtgaccactgtggcgggaaatgtctccctgccgcacacgacgtacaataccgtcaacggcctggcgtttatgggcagaggcgagatcctggtggcggctggagaagcggctccgcttgagcgtccgtaccgcgatgcaagcgagattcacggggacagcgggctgggagcattttcgtttgaacatcccgtggactatgggccagtggagaccggcggggtggaatttttatatgagaagctgatggaatcggaggagaagatcacgattctggctctggcgccgctgacaaatattgcgaagctgtttctggaacacccggactgtaaggaaaagattgagaagatcgtgtttatgggcggatccattttcagcggaaatccgacgccggttgccacgtttaatgtgtgggtggatcccgaggcggcaaggatcgtcatgaagggcggcgtcccattctttatgtgcccgctggataccaccagggaggcctatttgacagaagaagagctggaagtcatcggaaccatcgataatccggtggcggccatggtttataccatgttaagcttctattggagccaggagaaaaagaatgtgaacggacataagcggtttaagggattgtgcatccatgacctgtgcacggcggcctatgtgacgaatccggagctgtttcattcggtgaaatactacggagacgtggagacgaaagggccgctgacagagggcttcaccatgatcgactatgaggagatcttaaaaaagagggaagaagagaaaaatatcgactacattgattccgttgacagagacggtgtgatgaaggttttctttgaggctctgaaatcttattcaaaataataataagcgggccggcagcgcccgcttatgtgcttaatgctgcggtatgttacggtatgtaacggtaaatcgcgcgtaaagcgaacgaccgttagaaggaggtatctgttatgagacaaggggagctgatcgtcaatcccacactggcctgcgggaatcccttgaattttaagaaggatttagatatacttgagaatacaggaattaagattctgcatattgacattatggatggccattatgtgccgaatctctgcttcgacaccgggatggtggggctgatccggaaaaactattcgtttcttctggacgtccacttaatggtgacgaatccggcggactatattctgccgctggcagccgccggggcggattatgtgagcttccatctggacgcgacccattttccggtccgcacgctgaaccagatcagagagaacggcatgaagggcggcgtggtgctgaatccggcacagtctcccgagctgcttcgggagacgcttccccacctggattttgtgctggtgatgggcgtggaacctggattttccggtcagaggtttctggaaggaacggtggaaaaggtgagcagactgcgggatatgcgggagcagctgggcctctcctatctgatcgaggccgacggcggcgtggacagggagaataccgtaaccctgctggaaaacggggcggatatcctggtgtcaggcgcgtttggtgtgtttgagggcagaaatggtctcgaacaggattgcaaggagtatcaggaactggcgcttcgggcggccggggagcggtaggcaggcggaacagaacaagcagcagattgacgaaggggggaaatggtgtggcgacaattaaagatatcgcaagactggcgggcgtgtccaccgcgacggtgtccatggtcttaaacggaaaagactgcattaccaaaaagacgaaagagaaggtgatggcggccgccagggaagtagactacataccaagtattgcggccaaaacactgaagacgaagcgcagctataccatagccctgtttgtgggagatatcgcaaatccatttttcccggagatcatcaaaggggtggagggcgctgccaaagacaggaattacagcgtcatcatctatgacttgtccgggcaggatcaggactttgtggagcagatcgacaaggcggcgagccagaaggtggacggcttttttatcactggcagcacgcagatttccgaggaggcgaggaagcgccttttgatgattgcggactcggggatcaagatgatttcctgcaaccggtttatgaactggggcgaatttccgctgatctgtacctccgaggaagagcaggtggatggcctgctgagcaagctggcggcgttgggacataagcacatcggatgcatctccggttatccggaatactgggtggcggagcgcagggaaggcttttaccggaagacactggagcagtacggcctgtaccacccggagtatatcgtgaacggcggattctccatagaagacgggatccgcattacaaagaaactgttaaaggaacagccgcagattaccgcggtgatgtgtgtgaatgatacgctggcgatcggctgcaacgcggcggccagggaactgggactttcagtcccggaggacttgtccatattcggcgtggacggtgtggaatgtctgaaatatttcgccccgcagattacaaccgtggatacccaccggtatgagtacggctacagggggaccgtcaggctgattgacctgatcgaggatgacggaagcaggaagcaggagcttttagagactatggtatgcccctgttccatacggcagggtgatacgatcgccccgcccggaaatagcaaatagagaaatagaaaggctggataaaaatgagaatcggaattggatgtgaccacggcggatacgagatgaaggaagaactgaaaaggcggctgaccgccgccggccatacggttgcagataaaggcatttacagtgtccacgaggtggactatccggacgtggccgtggaagtggcaaagggagtcgtggcggatgagtatgactgcgcgattctggtatgcggaacgggaattggcatgagtatcgcggcaaacaaggtggatggtatccgcgccgcactggtgacggatacgttttccgccaggatggcgagagagcataacaatgcgaacatgatcacgctgggagccaggaccgtgggaatcgagctggcgtgggagctggtgaacgcgtatctgggagcggagtttcttgggggcaagcatctggtgcgggttgagaagattatgggcctggagagatgaccgggggaagataaagaatcctgacggtgcaaatgaaaatcatttgcaccgccaggatcttttttttcgattaatttttgcatataatgaatattgttaaaaaataaactaaaaacaggaaaatatttccttgaattattgtgcacaatgctgtaacataaacgctgtaacaatttatgagaaagggatgcagccgtatgagatggatgaaaaacaggggcgtaataacgaaaattacatggatgatcgccgtggtcctgattattcccacagccgtggtcgggattttttattataattcctataaaaaaacgctgctgaaagatgcgggcatccagatggaaagagagctggaagggcttaagaccaccatggacaacaacctggatgccatacacgccgtgattaatgagctgagctaccgtcaggaatttgcttattatctggatgggaagaacatcctgagcgaaagagaaaggcagcattacgcatccgggatggaggaggagctgatcaatatacggtacctctatccaaacctgttttatcagattgtggtatacggggataatgagtctcttgatttaaacaatgactggcagttcagcatggacatcctgaagaaaaaggcgtattacgatgaaattctgcactctgacagcgatctcgtatacgggagcgtgagaaaagcggattttttgatctcgaccctggatgtagataacttaaatattgttaaagatgggaaattgatccttcccgtttatttgaaaatcagaaatttaagcacgaaagacgtggtcggcattctggaggtggacatgtctgtggaaaagctggcggggaacctttttcagaagcaggacagggatacggattatctgatctttgacagagacgggacgctgcttcaccagaccgggacgtatgaaactgcggatttcgagcagtgcctgtttaaggaaaacgaaggaaaagggagtgtctctgtggcggaggagccctaccttcttacctacagccgttcgaaccgctgcggcctgatcaatgtagtcctgaaatcccggaaaggggtgctggaattcgcctccgagatgatgctccgtgtcgttgtggtggcgattgtctgcggcgcgtgtgtgattgggctgacgtatctgctgctgaagcggatgttaaaacggctggtggttctggacgacatgatgagccaggtggaaagcggtcacttcgatattgcgatccgggaggaaggccctgatgacgagatcaccaggattatccggcggtttaaccagatggcttctcatttgcaggccgtgatcaactccgcggtggagaaggagcaggcgcagaaggcggcggaactcagtgcacttcaggcgcagatcaatcctcattttctctacaataccctggaaaatatgcggatgcagtgtgagatcgacggatattacgccatcggggacagcctggcggcgttgggggatttgttccgttacagcataaaatggggcagcaatgaggtgccgtttcgcctggagtgggataatctgaaaaactatatttccatcatgaacatgaggtatcaggaagatttaaaatgcatcatggagatcggcgagggcgtgggagacgtcatggttccaaagatgctgctgcagcctctggtggaaaacagcttcagccatggatttaagcaggtgctcccgccgtggctgatcgtgatccgcgcgtttcggaaacgggacatgctggtcatcatgattgaagataacggaagcggcattgaacaggagcggcttttagagatccggcagtgcttaaagaatgatacgcccttaaggggggagaagaagaaacggtccatagggcttattaatgtaaagcagcggcttttgcatatctgccggggaggggcagagatttttattgacagccagcccgaccgtggcgtgaagattgtgattgaaatcaaaatggaggaggagtcagatgtttaaaatattgatagctgacgacgaaagattcatccggaaaggaattattgcgatcctgaaacgggggctggaggaagaaattcagtttgtggaggcgggaaatggaatcgaggccattgacctggcgcagaaggagcactttcacctggttatctccgacatcagcatgccgggcagcagcgggctggaatttatcaaagccctgaaggactcgggacagaccgccacggtcattatcctgtccggctatgagaattttgagtacgcgagggaggcggtccggctgggggttcgggagtatgtgatgaaacccgtgaaaaagccggaatttctggaactggtccgcacctgcctggaggagaccaggcagaagcaggagcagtcggtaaaggaggccagggaatccatcgcaaatgagaaaatattaaatcaggtgaaggaagaggtgctggtccagcttctcaacgagaacaggaaggaagtggtcgcccagtgtctggaacggctggagaagttcgggatcacctttcattcgtccctcttcatctgtgcggtcatcgaatatgaggttacggacagcaaccgggagtacatagattttgtggcaaagaacatggtggacgaattttttaaggactccttctttcctgcggtgacggtggagtacagcgagggaaggctggctgtcattatggagtttcaggaccagaaccgttttaaagaagagaaggcgaccgccctgcgcagtgtcacgggactgattaaaaaatactgcaaggtgcgtgcggttacgggcgtcggtgatatcgcctttgacgcatactgcttaaacaaatccctgcgccacgccatcaaggcggcagaatttaagatctatgatacggggaacgacctgtttttctacagcgatttggccagagggcatgattatgatccggtgccggcggagtcccttttaaaagaattcgatgaggagcacgcggtgatgcttctcaacgccttagaaccgctgatcgcagcgccatgctccaggcattctctggaggcggtcagaaaatgctacgaggaggtatgcggtttgctgaacgagcggacacaaaaagcggcaggcctctctccagaaccgcctgtccgctatcaggagttccgctatttctggaattttatccagatgaagcaggaattaaaaaagatgatccgccaggcaggagagctgatgcagcagggggaggaatccttaaattataagctgattcacgatattcttcagtatctggaagaaaatattacgaaggatatcgatctaaacacggtggcagaacagttttccaggacgccgggctatatcagcaccctgtttaagaaatcgatgaactgcgggttcaatacctatgtgacggagcagcgtatgagtatagccagaaaactgctggaggacagcagcattccaatccagaaggtaggagagctgtgcggctatcccaattccaagtatttctctgtcgttttcaaaaagagcacgggagaaaatcccaagcggtatcgggaaaagatagaaaagcatccagggaaggattaaaggcaccaggaaaagagtaaaacgtaccaggaaaagagtaaaacgtaccagaaaaagatgaaaaacgcatccaacaaaagagaaaaatgcaggccggagcatcggtctgcatttttgaattcataaaaatcaaacctttttcaacttttttgaacctccgcagtctgattatttttttataatagaattacagacaacaaacagagaggaaaggagttgaagacattgagtttactggatatgaagcagataatcaagagctttaacggcgtggaagtgcttcatgggattgatttttcactgcgggccggtaccgtccacgcgctgatgggagagaacggagcgggtaagtccacgttgatgaaggttcttgccggtgtacataaatgtgacgacggggaaatatggctgaagggaaaaaagacagaaatccagtcgccgaggcacgcacaggagctgggaatcgccatgattcatcaggagctgtcgccggtgccggagatgaccgtagccgagaacatctttctggggcgggaaccgagaaaagggctgttcgtggattacaaaaagatgtacacggatacggaaaagctgctgggtgaaatgaaggtccgggtaagtcccagggcgaagatcggacgattaaaggtagcggaccagcagctgatcgagatatcaaaggccatttccctgaatgcggatatcatcgtaatggatgagccgacctccgccattacggatcaggaggtggagatcctgttcaaaaccattgcggatttgaagaaaaaggggaccggcatcatttacatttctcacaaaatggatgagatattccgaatcgcagatgatatcacggtgctgcgggacggaacgtatgtaaacagctgggaggcaaaggacatcgacaacaataccctgatcaagaacatggtaggccgggagttaaatgaaatcttcccaaagatcaaggttccggcgaagaacgtggtgatggagatcaggcatttcacgaaggaaaaccagtttgaagatatcagctttttagtgcgggagggagagatcctggggatcgccgggctgatcggagcgggaagaacggagttgatgaacgccatcttcggtctggaaaaaccggattcgggtgaagtgttcttcgaaggaaagaaagtggagatcaggcggccttccgatgccatccgccacggaatcgcttacgtgacagaggaccggaagaatgagggcctggtgctggagatgggagtaggacagaacattaccatcgcctccatgaagacgcttagcagcggcatatttattaaacgccaggaagaaaagaagacgatcgacgatcagatcagggcattgaggatcaaggtgcattcaccgaggcagctggtcggaaagctgtcgggcgggaaccagcagaaggtggttctggctaagtggatgatgaaaaatcccaagctgttaattctggatgaaccgacgagggggatcgatattggagccaagtcggagatttataagctgatgggagaatttgtggagaagggcaactccatcatcatgatttcctcggaaatgccggaggccatgggaatgtccgaccggatcctggttctcagcaacggacggttaagcggagagctgagccgggaggaatttgtccaggaggatatcatgaaaatggcggtctcctatatctgataacgaaaaggtgaatgaaatgataaaaacagagaaaaaaataaatataaaaagctttattgctcaatacggtgttatcgttggtctggcggcgatcctgatattctttacggtcatgaaggcaaagtttatgaccgtggataacatcgttaatatgctccgccagacgtcgattaacggactcctggcaatcggcatgacttttgtggtgctgaccggcggcattgacttatccgtgggttccatcgtcggagcggccggcatgttctccgctctggcagccagggcggaaaccggaatcccatggccaattgccgtactgatcggcctgggagtaggactgctgcttggtgcagtcaacgggattgtggtctcttacttaaaggtccctgcatttatcgctacgctgggaatgctgagtattgccagaggcgtaaccttcatggccagtgacgccaagccggttccgggactcagcaagggatttttaaagatcggcggtggaagcgtcggaatccttccataccccgtactgatcttaatcgtggttctggtcatctgtttcatcgtgctgtataagacgaggtttgggcggtatgtgtttgccacaggcggcaacccgtcatcggccagggtttcaggaatcaacgtaaaacgcattatctgctctgtctatatgatctccggtctcctggcgggtctggcgggaatcatcttaacctcccgcgttacttcgggtctggcacagagcggcaacggatatgaggtagacgctattgcggccgcggttatcggcggtaccagtttatcgggcgggcgcggcagactatggggaaccattgtcggtttcctgattatgggagttatgaacaacggtcttgatatgatggcggtctcttcttactggcagctggttatcaaggggttgatcattatcggcgccgtcatgctggattctttaaatggcgggaaatagaaaatcttaaattcaggaggaataaaatgaaaaagaacaaaaaagtattgggaatcgtgttatgtatggcaatggcagtcaccgcccttgcaggctgcggagcggcagacaccagcgcaaaaaaatcggatgacacaaaggcggcagacggcggcaagaccgcggacggaagccagccagcagacagcggaaagaaactgaagctgggtatcaccttatacagcttaaagaatgaatacactgtccgtcttgccaatgcggcgcagaggaaggcggatgagatgggcgcggagctgatggtttacgacggcaactacgatcccagcacacagatcagccaggtggagaccatgatttccgacggatgtgacggtattattttaaatccgcaggattccgacgcgtgctccccgtgcgtagacaaggcagtggaagcagggattcccatcgtggcggtcaatacccgcgtcaacaacgataagataaccagctacatcggctcccaggatgtcattgccggggagatgatcatgcagaagatcgcggatacgttaggcggaaaaggcaagattgtcattatcgaaggccctatgggacagtccgctcagatcgagagacggcagggaatccagaatatcctggataagtatccggatatcgaggtgctggctgaaaagacagccaactggtcccgctcagagtccatgaccgttatggagacctggatgcaggcatttgaccagatcgatgccattgtagcggaaaatgacgagatggctcttggtgcaagggaagccgtcaaggcggcaggcaaggatattccggcagtgggtgtggatgggattaatgacgcactcgcggcagtggaggaaggcaatatgctgatcagcgtattccaggacgcagccggacagggaagcaaagcggttgaggtggtaatcgatgccatcgataagaaaccggtagagaaggattactggatcgattttgaagaagtcaacaaagagaatgtagcggagtttaagcagagagcacagcagtaaatatagcagttaatatagcagtaaatatagccgtaagtacaaagcaattaaggaggaagatcatcatgttacaatattacggagcagacccggaattttcattagaaggaaagaccgctgttattacaggcggagcagcaggaattggttatgaaacagcgaagtttttcgcaaaaaagggtgtgaatctggtcctggcagacttaaatccgggggtggatgaaatcgctaaggaactggatccgaaggccgttggaatcgcaggcgatgtgacgaacggtgcttaccgccagtctgtggtggatctgggagtgaagcagtttggacagatcgacattctggtcaactgtgcggggattgtcgcgctggaaaaagcagagctgatcagtgagtccgactgggaccgtaccatgaacatcaatctgaagtcctcatttatgatggcgcagcttcttggaaagtatttcattgacaaccatgtgaacggctccattgtcaacattgcctcccaggccggcgtgatcgccctggataaacatgtggcctactgtgcggcaaagggcggaattattgccatgacgaaggtgatggctctggaatggggaaaatacggcattcgcgtcaatgcggtggcgccgaccgttgtgctcacggaactgggacacaaagcctgggacggcccggctggggacgccttcaagaaggagatgccgtcagagcgctttgcagagccggatgaggttgctggtgttattgcattcctttgcagcaatgcggcgggtatgattacgggacacaatctgctgatcgacggcggatacaccattaaatagagcgggaggttttggaaatgcagagaatactgaataatccggatgatattgtagatgagatgctgaaaggttttttgaaagtgcacgcagatatcgtggaggccacagataatggacgtgtggtaaaggccagaaacattccggcagataaggtaggcgtggtaaccggaggcggttccggccataaaccggcatttatcggctacataggcgagaatatgtgtgatgcggtggcagtcggggagatctgttcttcccccaccgcggctgcgttcttagatgcgtttaaggcagcagaccagggcaaaggtgtggcgtgtctctacggcaattattccggagacaacatgaacgtgaagatggctgtaaaaatggcaaagaagcagggaatcgaagtgaagaccgtggtagccaatgacgacgcggcatctgcgcccagagaccagagggagaaacggcgcggcgtggcaggcgagatcctgatgtggaaggtgggcggtgctaaggcggccatgggcggcagcttggacgaggtgatcgaggcggccagaaaggccatagataacacaagaagtgtgggaatcggcctgacgccgtgtacccttccggccgtaggccacccgaattttgagataaaagacgggaccatggaagtgggaatcggccatcacggagagcctggaatcgaggtatgtgagctggaaacagccgctcagatggcaaaacgcatggttgacgtcgtgatacccgattatccgttccagtccggagatgaggtggtcgtgctggtatccggactgggggcaactccggtcatggaactgtacgtcttatatgatgaaatcgaccggctgctggctgatcaggggataaagacgcacaaggcatacgtgggcaattactttacctccctggatatgatgggggcgaccctgaccgtgatgaagctggatgaggagctgaaggaactgattgatatgccggcatacagcatgggcttaaaagagaagcagaagggagcatgaatatggacactttcaggaacggggacggtaaatccatcctgcttaagatggtaaaagccattcaggacaacaaggcgtatctgggtgaggtggacggtctgatcggagacggcgaccacggcatgaatatgaataaaggatttacggtatttgagaccagatttgcggataaagagttttcctttacagacggcctctatgagctgggaactattttgctgaatgaaatcggcggttccatgggccctatctatggaaccatcctgatggatatggcggaagccggggaggagttagacgaaatttccctggaggacatgggtaatatgatggaagccggactgaacggcctgtgcggcattgtagatgccagagtgggtgacaagactctggtggatacgctttccccggcggcagacacgctgaaaaaaggagccgcggagcacgcgggattcgcggaaacgctggaggcgatgaaggaggctgcggccgcgggcagagattccacaagagagatgacggctaaattcggccgctccagccgtctgggagagcgctccagaggagtcctcgacgcaggggcaacttcctgctgcatcattctgacagccatggcggatgggattctggaaaaactgggttgatcgtcgttttggggatttttgtctgtgtctgaaaaggagaaaaatgtcatgaagatagcaattggctgcgatgaggcagcatattccttaaaagtagaaattatgaagcatctggacagcaaagggatcgaataccacgatttcggagcagataagggggaaattgtgctgtaccccgatgtggccgtaaaggtggcggaagcggtagccgcgggcgcgtatgaacggggaatcctggtctgcgggacagggatcggcatggccatcacggcaaacaaagtcccgggaattcgggccgctgtatgccacgatccattttccactgagaggtccaggaagagcaacgatgcccagatcatgtgtatgggagagcgggttatcggtgtagaactggccaagtatctggtggatatctggctggggtgtgatttttccggcggcggctccgcaccaaaggtggaccgcatcatggagatcgaaaaagagtataaagacaagaaaatatcctgaaactgaaaacagaggatattaaaaacggaggaaattatggggaatttacttgcagcccagtccggcggccctaccgcggctataaacgccaccttgagaggaattttggaggaagctatggtatgcggccgttatgaccgtgtctacggagggctttacggaatcaagggaatccttgaggaacagctggtggagttatcggatgtatttttaagtcccatggatctggacctcctttccagaactccgtcgtcggcgctggggtcctgccggtataagctgggagatataaagacggatgaaacggtctatgcgaagctggtctccatctttcgtaaatatgatattaccggttttatttacattggcggcaacgattcgatggacacggtgaataagctgtcccggtatttagagcagcgcgggatcacggatatctgcgcagcgggcgcgccgaagacggtagacaacgatctgacggagacagaccactgcccgggattcggctcggcagcaaaatatatcgctaccacattttctcagctggagcgggacctggcggtctacgatacgtttggagtgaccattgtggagatcatggggcgtaattccggctggctgactgccgcctccgcgctggcgagacagaacggagaccgcgggcctgacttcatctatctgtgtgaaaagccgttttctgtggaacggtttctggaggatatcagaagccggcagtcagagaggcgcggcattctcatcgccgtcagcgagggtgtccgggatgaagacgggaagtacgtaacggagacccgggaggacagccggaccgatgtcttcggccatagggatatcgccgggacgggaaaggttctggaggagatcgtcaggcaggagattggctgcaaggtgcgttccatcgagctgaatctgatgcagcgatgcgcctcccaggcggccagcagtacggaccttctggagtcgcggctgctgggagccatggcggttcagtgtatccttcagggaaaaaatggccatatggccgttgttaaacgggtgaagaatcacccttaccgtgtcgcctacacgtctgtacccgtaagtcttgtggcaaataaagagaagacggttccgctggagtggatcaatgagcagggaaatgatattgaacagccgctcatggattacttgcagccattgattgcaggggaggttcctttcagtttaagtaatgggattccgttgtattttaagattgggcagtggaatgaggcttttctgcctgaatattagtaaacttcggaaaacacgaaaagatttatccttccaatgcctcacaaagcgcaataagcgccagagactgcccgtatgccattggcataacagcaatattcttatagtgttcggaatccataccgatgccggttccggcggatacgtttaaaacggttccgtctttactgacattgcggcagatggcttcaatcgcctgatcagccactttacggtaggatgagtcaaggactcccgcgcggagtccttttaagattcctgcggtaatggcagcggagccggatacctcttcgtagctggtctcgtccgttaagacggtgtgccatagcccggaaggggcctggaggtttctaagggcttcggcctgggccctgaaagtatctgtcaaatatgcattaactcccggggcaattcctgatttgcaggcatctaaatagtccataactccataggtaaaccaggagttgccacggcaccagaagatcccgccgaagttgtcgttgcgttcaaaactgaagccgtgatggaacagtccagtctgcttgtcataaaggtatttgatgtgaagtaaaaactggtgaactgcctcgtccttccaggaggcattgtcatagcgctggccagccatatttaagaagagaacggacattaccagggtatcgacccatatctgtccatgatttaagttgacgccgttcctgtctccgatggcgcttgtgacgtgctggaagccgccttcctttgtctttggcagctcgtggattagccagtctgcacgttccaggcacatggctttatagttatccgcctcaggaagctggtcccagaggttgacaagggcaagaaatggggccgttgtgttgatattctttgatgggaggcccgattgaatattgtgttcataccagttggagaaaaagtcattgtaccttccgtcaccgtagtgagtctgaagcttgtaaagaccatagagaccgattccctggggccagtcccattcttcaattccaaaatcgcgctggatgatgccctttcggcaggaatccttatctgcagtcttatcctgctcgtagtcggagccgccgagattcatgagcttttttaccacaaggtgaattttatccagaagctgttcgtttttcatcatgtttcctcactttcataaatattactgttgttttaagttttctatataatcagtaggtgtaaagccggtatggcgtttaaaaacctgactgaaatactgcggattggcgccgaagcctacggaacgggcaatatttttgatattatcactgtggtagtagaccatgagccggatggcttcctccatacgctttttatttaaatagtcggaaaaacgcataccttcttcctttacaaactgtttgcttaagtatcccacactgacgaataaatagttttcggccagccattttaaagaaagattttcagaatctaaatgttgttccacgtaggtttttaaaagggcaatgttggcactggttttggagacaccggaatttgtgttcttttgtattaaaacaacctccattaagcaccggatctcggaaatgttgggacaggaatagaggcgtcggaagaaatcacaggcgatgtcaagggactgttcctcatccggattcagctttaaaaagaggcttagagctaaatttctggctgtgtccagaggtatacccggagaaaaaaccgtgtcgagaagatggcagacctcggtctctcccctggcacttaataaagattcttccaattggctaatgtgccatggagaggtaatattatttctgatttcatggatttttgtggaacgatctgccagaaggatgcgctcatatctcgcaatctttatcagacatgtgtgaaacagcgcttccgatgtggcttcatgaaggaagctgatatcaaaggatacggactgaccggtgtacgataaaatggtcagggcctgccgaatttcctcctggcaggcgagtgtgtttgcagggaggatcagtatggcactgttccttacatagatagcaggaaattccagaggagaaccggctgcctggcagattttcccggcatctttcaggaaggtctttaaataagactcttctacgaaggaacagatgcaggcggataacccagaatcccggatagataaaagcgactgatatttgccataaattgaggagaactcttccggccgttccagggcttccataataaaactctgctccagaggagcctgcaaatcgcgaagcagatgctcctgttctttctgccttcgtgcctccttaagggtcagctcgtggcggatcgatacgagagaatcaattagctcctgtttgtccgttggcttcagtaagtaatagcggacgccatatttcatggcctgtttggcatactcgaattcactgtagccggacagcagtatgaaggtgatcttagaatccgacttcatagagcgctcgattaagtccagaccgtttaagatgggcatacggatatccgtaattaccacatcagggtattcatcacagatgaaatcataggcctccatgccgtttttggtggttgctatcaactcataaccaatagaagtgtagtcgatcatttcggataatgcttcacggataatctgttcgtcatctacaatcattaatctaagcatgtaattcctctctctcttttgggatggacagcataacgacagccataccgtctttattataaaatgtcagaccataatggtcaccgtatatgagctttaagcgggaatcaatattaaccagcccgactccggagccctggggggtaatctggcggtgctctattttccagagtaagtcctcctcaaattgagaaccggtgttggctaccttgattcggtaactgccttcacgttcccggacggttacacggatggtacatatttcgtcggtgtattccatggcatgctttaatgcattttctaccagaggctggatgcacagttttggtacgaagatatgagagatgtcttccggtacgacgagttcgaagacgaggcggtctttaaaacggattttctgaatctgtatgtagttatccaggacggctagttcatcggcaagagggattagatcaccttcgccggtcatggaggcccggaacaggttgcctaaggaacgtaccatggtggaaatatcatcagctccgtatttctgcgccatccagttgatggtgtccagagtgttataaagaaagtgagggttgatttgctgctggagcatcttaatggtggcatcccgtaaaagcagttgtttgtcataattctcatctcgcagaactttaacgctctttgtcatctcgtcgaagtttacgtgaagctgaccaatttcgtccctgcggtttacgtaatcatattcccgctgatcttccggaaccggctcgccgtttccaaagcagcggattttttccacaaggaaatccaggtgctttaagacatggcggaacacggcctctaccagcagcatggcgataattccgaagcaggcggaaaatatgagtacccggaggcgggcggcctgtatatcgtgaaagatgggatcgtaatcacggaaataaaggtagtcccagcccgtatatgcaatacttccggcgatgatgaattccttattacggtcaagtgcctctacggaataggaggtgccatgcagagtcattgcagagagtaagtcgtcgtagcggtcgtcatgataaggcgtctccggataaaaacgttttccatctgccatcatgaccaaacgggaggtttccggagaatatccggcattggctaaggcgtcgcggatcaggcgttccatgtcaacaatgatatagagggaagccagttttcgtaaatccaggtacttgagctgcctgatctcccgagaggcggcaacatctccaccggcagctatgcccagttcccagacaagacgcccttccgcatcagtgacatctctgtccatggaaacgatgtcaaattttcctatatcagaagaacttcccatgcagatcttggtaccgtcttccagcacaatattgatggatttaatataattgtcataaaacgtatagggataaagcccctgataaatatctcttctggccagagccccacggttgcttcctgggttgtcttttaaaaaacagaggttattctggatgacaggatcgctgattaagctgttggaaatcgtctcgattgcctgaagctcggaagccatggaagaagatacatggtttagcgcctgggcattagcctggtataactccttctcatagcggccggtcagaatatggatgctgagaaagaagacgaagtaggtgcagatcagtgtgactgagataatcagcagtatttttttatataaagtaagattattaaaacgaatttttaatactttcatggaaagaagacctccttgatttcttttgtattatatagtataaatttggtttacaaaagtagctgtggacaaaatgtcgtttttttaaccatgaagagccgttttttaactttaccgttatgcatatttcacataaaataagagcatcaaaaaacaattcaataaaataacgatcgggaggttattcaatgaagaagagattagcagccgccgccatggcagccgttatggcagcagcatcattaaccgcatgcggcggtggaaagaccgagacacaggcaccgacaaaggctgcagggaccgaggcagccggggatacacaagcggcgggagatacgcaggcagccgcttcaggtgagaaggttactctgaacctttgctggtggggaaatcagaccagaaacgatgttacaaaaaaagcagttgacttatatatgagtcagaaccctgatgtggagattaaagtagagtttacggactggtcaggttactgggataagctttcggctatggctgctggcggcaatctgccggatattattcagcaggactattcctatatcaatcagtaccagaagagcggtcagttggctgatttaacaccgtttattgaggatggaaccattgatacctctaagattccagacagcatcatagagagcggtaccattgatggaaagtgctatgctttgagcctgggaagcaatgcgccgatgatggtttacgacaaggccatcttagaggaagccggtgttactcttcctgaacagctgactgtcgatgaactgtacgatatttcaaaaaccatctatgaaaaaacaggggctaagacatattacgatggcggaatcaatatgatgcagatcgtagcaagggcaaatggatcccatttatttgatgagctgaatgccggcgataccgcttcctccaagattcattttggcaacgttgagaaatttgccacagcagaattctccatttctccggatttactggcagagaagaatccggatgtcgtagagacaaaaccaattattgatgaaactacatggaatgacttttccttctcaaaccagttcatcagtatttccaatacatccggaagagatttaggcatcaccatgtatccgactatgacaggcgcttccgagcagccgatgtacttaaagcccagtcagttcttttccattgctgaaacatctcagcataagaaggaagcggcagaattcatcaactggtttaccaatagtgttgaatgtaatgagattctcatggctgaaagaggaattccgatcaataccgaagtggcagatgcgattaagccaaaggtagacgaggcatcccaggtggtatttgagtatattgcaaaggtatcagagctggcaacaccaatcgacgctccggatccggcaggcaagggtgaggtagaggcccttggcaagacaaccgtggaagatcttcgttacggtgatgtaacgggagatcaggcagcggaatcctttgtagcagaatccaggaagattctggaagaagcagcgaaataagagttaagaaggtctggaggggacaagatgaagaaagaacaaaattccccgaagagaaagaaaacattgatgcagatcatgaatactccgaaggttgcaggatatgtatttatcctgcccttcatcgtgggattcatcgcttttatggctctgccgatgctcttgtctttcgggttctcatttaccagatataatattctggaagcgccggtttttattggactggaaaattacaagaccatgtttacgtctgacccgaagttctggaaggtatttggcgtgaccatgtattacgtgctcttttccgttccgctccggcttcttatggctcttatcgtggctatgctgctggtaaagagcacaaagctgtccgggttttaccgggcagtctattatctgccttctatcattggatccagtgtggctgttgccattctctggaagcgcatgtttgccagcgacggtgtcatcaatgctcttctgcagacgatcggtatcaacagtgagatcgcatggctgggacgcaccgatactgcgatttggaccctgattattttagctgtatggcagtttggttcttccatgctgatcttcttatccggtctaaaacagattccggtcagtctctatgaggcggctaccgtagatggagccaatggcattcagaggttctttaagattacacttccaatgctgacacccaccatctttttcaacctgattaaccagttgattaacggctttatggcatttacccagagctacatcatcacgcagggaaagccaagagacagcacactgttctatacggtgtatatgtattttaactcctttacctataataagctgggatacggatgtgccatggcatggttcatgattttcgtagtgggcatgctgacgctgatcctctttaagactcagaacaagtgggtatattacgaatcggaagggtgatgaggtatgaaagcaggatataaagaaaaacgaacggccattacagtgatctatcatgtattcatctttttcttcgcatgcgtcatgatatatcctcttgtatggatggtaatgagttcctttaaggatactaacgagattttcaggactgcagccagtctgtttccgaaaaaattctcttttgaaaattataaggtgggctggcagggcttcgcaggctacagtttcggcctcttttttaaaaactcctttatcattgcaggagtatcgaccatcggagcggtgatttcatccgcagtagtcgcttacggatttgccaggattgattttaagtttaaaggcttctggttcggctgtatgctgctggctatgatgcttccgttccaggttattatgataccacagtacattatttttaataaaatgggctgggttggctcttatctgccgctcattgttcctcagtttttcggacagggcttctttatcttcttaaatgtccagtttatcaagggaataccggttgatcttgatgaagcggcgagaatggatggctgctcgatctattccatttttacaaggattattcttccgttggtaaagccgtctctggttaccagcgcgattttctcctttatgtggagatgggatgatttcctttctgctttactttatttaagcgatccgttaaagtatccggtcagctatgcattaaaaatgttctcagacccgacggccggttctgactggggcgctatgttcgctatggcgacattatctctgattccaattttccttatttttcttaccatgcagaaatatttggtagaaggaattgcctctacagggattaagggataagagcagagtgtatgcttaccaggtgggggaaccgtttcttcggtttctccgcctttttatgtattttgctggattttatgaattttgccgattttacatttttaattgattttgtgtattgcgatacaggaagcgaaggagacatatggattctatcagaaacagaataaagggaatactggaggcggtcggtgaacagatgcttgccgcgcgggaaacggttgagccggtgaagatatgcgccggtgattacgccttttcggaaaaatttgatccggcagaccacgtatggagggacttcggacgggacgagacgtggggcggaaaggatctgcactactggtttttggcggctgtgaccgtaactgcggccatggacgggcggcagatccgggtgattttgaatacgggggccacggatatttggaacacggataatccgcaggtaatggcctatgtggacgggcggctggccggaaccatggacttgaaccatcaggagctgattctcagcgatcatggcagggtgggggatacgtatgcggttggtttttatgcgtattcgggtacgccgtcctacactaatttctttcacttggatgcagccgcctggtgcgaggaggccgcaaggctctattacgatatgaagaccgtatgggaggcggcggatttgctgcctgaggaccatatagagcggattgacgccatgaaggcgctgaacggctgcgccaatctcctggatttacgaagcccgggttcggaggagtgcatccggtcgctcacagcggcggcggattaccttgaggagcaatattacgggaaccgcaggagaaatcccgtgacggttcacagcgtgggccacacccatatcgatgtggcctggaaatggccgctgcgccagacgagacagaaggcggtcaggagctttaatacggttttgaatttaatggaccggtatccgaaatacaaatttatgatgagccagcctcaattgtaccagtttgtgaaggaggaggcgcccggcgtgtttgaacgggtgaaggagcggatacgggatggccggtgggaagcggaaggcgccatgtggctcgagccggactgcaacttgtcatccggagaatccttaatccgccatatcctctacggccgtaagttctttgaggaggagttaggtgcgccggcaaatgaggtcctgtggcttcccgatgtgttcgggtacagtgcggcgcttccgcagattatgaagaaatcaggcctttcgtactttatgacgacgaagctgggctggaacgagtacaatcagtttccacacgataccttcctgtggaggggaatcgacggaagcgaagtgctgacgtatctgatctccacgagggattattggacggaaggggaaagaagaaagaaatctcctttctcgacgacttataacggcaggcaaaacgccagccagattatgggaacgtggcagcgctaccaggataaggacgtaagtcgtgatgtgctgacctgttacggctacggtgacggagggggaggccctacggaggagatgctggaggagagcaggaggctggaggggagtgtggcggaatgcccggccgtacgccagacccatgtgaaggagttctttcatcttctggaggagcggctggacagagaccgtctgtcggtctggtcgggagaactgtatttggaataccaccgtggcacgtatacctccatggcaaagaataagaaatacaaccgcctctgtgagttcttaaacggcgagacagaaaagtggtctgtcctggccggacttctggacgcttcgtaccgctatccgggaaaggaactggagaagaactggaaactgctcttgctgaaccagttccatgatattcttccgggttcttcggtgaaggaggtctatgaggattcggaccgccagtaccgtgagctgatcgagtcggataccgcccttatggacgaggcaaggaagacgatactggcatgcctcggggctgaacgggcagagaacgccggaggtgcgaaggaaaatgagacttttgggaactgcggccctgcaaagcgtctggctgtgtttaatccgctcagcttctccagaaccgggattgtggagattggggaatgcggggagagtgactgtataagaggactggttttccagagagcggcggatggaaccatgctttatctcgcagaggcggcgccattgggcgtctccatcctgggaggggatacaatcggggaggtgatcggggaggtgatcggagatacgaacgggaaagaagcatcagaaagcgttaaagaagcatcagaaagcgctgcggatgtaaggctggatgggctttcctgtgcggtttctaatgtattcaagtctatcacgaccagcggtgacggacagcttaaggggcttacaacaccattttatgagacagagttcgatgaaaatggggagatcagccgcctcgtggatctgcgggagaagagaagccttataaaagaaggggagacggggaaccgtcttgtagtgtatgaggacaggcccatggaattcgatgcctggaatatcgacgactattacagggagaaatcctggccccttaccggcctggtatcaatcgaagtactggaaaatggtcctgtgcgcggctctgtcctggtcaaacggagatttatggattccgttctggaacagatgatctgcttttatggccatacggccagaattgattttaagacgaaggtatcctggaggcagcaccagctgctgctgcggactgcatttcctctggatattctctgtaatgaggcggattatgagatccagtttggaagtgtgaggcggcccacccatgagaatacgtcctgggacagggccaggttcgaggtctgcgcccacaaatgggccgatatggcggagccgggatacggagccgccctcttaaacgactgcaagtacggatacgggattcacgattctgtcatgagcctgacgctgattaaatcagggattttcccgaatcctgaggcggatcaggggctccatgagttcacatactccctcttcccacacaggggagatttccgggaaggcggagtggtgcgggaggcgtaccgcttaaactgccctctgatcggcatagcggtacggaaagaggggacggagaacgtatccattctggagatcgacgaggagaatgttctggcagacactgtgaaaatggcggaggacaattccggtgtgattataaggctctacgaggcctggggaaagaggacgaatgtccatatgcgcgtcagaaaggaagcgggaaccgtggtgcgggagtgcagctgtatggaatatgaggaacatgagttggaagaagcggctgccgcagaaggagcttctggcagtgtgagcgcggaagccggaaaagacgggctctgtctggaattccagatgaagccgtatgaaatcaagactttaaaattcagtaagtaaaatgagggaggaaccgttcatgtataatattatggattatggagcaatgggagacggagcggccaacgacgcgcctgccatccagaaggcagtggacgagtgcagtcaggcgggcggaggcgtagttttatttccgggaggaagagtttacagatccggcagtgtcgtgttaaaatcaaatgtagagattcacttggagccgggggctgtgtggaaggcatgggacacgatagaggagtattatccgcttagaaataacggacgcatcacggtccacgaatcgggtcttccctcatttttaaacagcgagtatgcgggaagaccgtttaatgcgtttatttacgctctggaggaagagaatattaccatttccggtcaggggacaatcgacggaaatgagagtatcttctatggcgacaattcgggataccacatcgaggggacgtattatccccgcgtgccgctgcttcttctggaagcggtaaaccatctgacgatacgggatgtcagactggtcaactgtgcgttctggacggtccatctggtgggctgcaacgatgtgctcatcgacggaatccggcttttgaacaatttgaaaatggccaattccgatgggatcgacccggaccactgtaaaaacgtgaggatttctaactgccatatcgagtgcggcgacgatgccatcgttctcaagaattccggcgactataagaaatacggggcctgcgagaacatcgtgatcaccaactgcaccctgatctccaccagcgcggccatcaaattcggcaccgaaggcgaatcggatttccggaatatcctggtgagcaactgctgcatccataggagcaaccggggaatttctatccagatcagggactgcggcaatgtggaaaatgttatcttctccaatatccgcatcgagacgcggcgtttctctcacgaatggtgggggagagcagaagcgatctgcttaacagcccttgaccgcaagccgggagtgaaagccggaaagatcagaaacatcctgttccgggatatcacctgcgagggggaaaacgggatattccttctgggcagcagtgataattacatagaagacgtgaccttcgatcacataagactggtactcgaccggaaatcaaagtgggagatcgagggatacgataagcgtccctgccagggagatggagagatcaggacgatgatttccggcatttatgtggataaggcgagggatatcacatttcaggatgtgaagatcaggaagaaggaaggaattcttccgtattaccgggaagacgtcaccctgctcgatgctgagcgcgtgaagatggatgcggaggcttagggcaaaatggactatgggttggacatcttcatgattgaaaaggagaaagacaagatcgtggagatcctgaaggattacgtccgtgaggttcacgcaaaccttggataaatagacaggaattccacgatcaccgtccgtggccgtcagattaaaatactgaagatccagatccccaattgggagaagaatgagaatctctatcacgtccgcctgatggattttaaggatgagataacggcaagattgcggccaatttgaggaacgggatgcagtatctgaagtccggtcatatccggggatcggaggaggagacgatagtgctgtcgcaggttgaggtgaatgagcagctggagcttaatttgttttgagacagataaggacgctgcgggaaacctgcggcaggtatatggatgagagaataaagattatgacatataatagattgaaaaaatcatgattgacagaagaactggaattgatttataataaaggtacaaaaaaggcagtacactccagtgagtggcttccaaagaataactgttataaaaaatagtcgttaaacttggtaggttgggcggctatttttttgtacctgtaatcataacgataagtaccccaaacgcaatcatcaaagaaagtgtctcatatgtactcatgttataccaccccctttcggagatggaagtcacccagcagtagtactgcctgcttccattatacaaggcaatgaataggctgtaaatagaagaatagaaaagaaatttacagagatttatcttcacttacaatagcggcaagcagaggatagacgcactagtcaacgccggtaaaattccgttcaacttaaccgttgataaggaaggttggtttcgctgttccgtacagggcagcattataattataaatttcatataagggtgttatgatatttagcatataaatcaacaaaatttaatttgacggagaaattatgttgtgaaagttactattgaagaattacaggcttatttgtttgaccattatagcaagggtggaattcatcaaagcttatttatgaagctgatagaagaaataggtgaggtagcagagggcctaaacaaaaaggctggcagaaaatcaactaatacggaagatttgcaggctcaattgggtaatgaattagccgacgtgatacattatgctgtagccattgctgcattaaatgggcttgacatgaatgacattattgagcaccccaaaacagaagcaaagttacaaattttaccaatgcattaagaaacatatgagtgctttaagcgcattgtgccaatacactttttgaaacaaatatcctatttccaatccttctggatctctccagccttgtaatgtcaaacaacatttaccaatcatttcatttgtctcttttaaaaacatctgcccaaaatccgaaaacgtactctgcatagcgtttaaaatatctgtcaagccaattttatgctttttctaagatgaatgtacttccataagcagtatgtattactttttcatcacacaatattttacacaatgcatcaaaagcggactgcaccatttctctaatcataaggtgttccgtttttatcaacttttttctgtttcctgaacttttttctgctattagtaatacttccacaacttccaatttgtagatttaatagacatatttttatttgctcaatccggacctttttacattatggctgaggtattgctgtgcaagctgggtaatggagtacatataactgtataagataaaaatacaagataaaatgatataaatgatataaaaaacataaatgatatagtaaatattgacattgatatatgataatgctatattgtatttaaatgaaacagctgctgtacagaaatataccatctatttggaacattttaccatgagagaagggggaggtattttgaattacataaaaaatgatgaaagaagaaggaacaggcacggatttggaaatcagaatgttatgggaagagtctttactgcaccgccggttcttctgtttttcttattcacctttattccgattattatggcggtggtgatcagctttaccgactacgatattgtgaacgcgccccggtttgtgggtctgtacaattacaggaagatgataaatgacgaatttttctggattgccctcaagaacacgtgcgtatatacgcttctgtatgtgccgggcggcctgctcctctctctgggagcagccctgtacttaaatgtaaaccggaagtttgtgagtgtcttccggacgctgttttatctgccggtgctttcctccacggtggcgaccgccacgctgtggttctggatcctgaatccgcagctgggcctgttgaacggagttctggagttgtttggcatttcggggcctgcctggctctatgacagccggtgggctatgctggccgtggttatgatgagtctctgggcgggattcgggacaaatatgatgatcttcttatccggtttgaagggggtatcccagtctctgtatgaggccgccagagtagaaggcgccaaccggtggcagatttttacgcatatcacatggccgtccatctccaagaccacgtttctggtgacgacgatgctgattatctccagctttcaggtgtttgaccaggcgtttatcctgacgagaggaggccctggcaatgccacgatcacactggtctattacatttataacaatggcttcaataatctgaacatgggctacgcctccagcatttccatggtcctgtttctgattatcctggtgttttccgtattgaataccaggctgaacaatgcggatatttaagagaggaggaagaagatgaacagccgtgaagtgaaaagacgtacaaagagtattttatggtatacgggagcggtcctgatatctcttgccaccgtatatccgttcctgtggatggtatccacatcgtttaagccggaggcggagatttactccaactccctgtccctgctgtcctcgaagtttacactggccaattatgcgaaggtgttcagaaccatgccgtttgccaggtattttatgaattcctttatcctggcggccagcggtgtggcgacaaacttattcttcggtgcgctggcgggatacgggtttgcaaagcttaaatttcagggaagaaaggtgtcgtttctgatcctgctgtcgtcgatgatgatcccggcggtcgccaccatgattccccagttccttgtcttaaaattcttccctctggtgggaggcaataacttattcggacagggcggaaacggttttatcaacagctactttgccatcatcattccgggcgcggtaggggcatttgcagtattttttatgaagcagtttttcgagactctgccggacgagctggccgaggctgccagagtcgatggctgcggagagtttaagatatttacgaagatttactttccgctgatcaagcctgcggccattacgctggcgatcatgacattccagtcgggctggaacagctttatgtggcctctcatcgtgctgaactccgataagatgaagacggttcaggtggggctggccacgtttcagtaccagtatgacacccagtacggtccgctgatggcaggcacggtgatcgccaccctgcccatggtcctgctgttcttatttgcacagaaatactacgtggaaggaattgccttcagcggaggaaaataaataatattcaaacaagaaaaaggagaaaacaaatatgaaaaagttaatggcggccgttctgacggccacggtagcgacaggtctgctggccggatgcagcacgggcaatggcggaaatggtgagaagggctctgaggcggcgggaaagcaggaagtgaccatgtggggctccatgagcggcgacgcagtggaatacatcaaccagatgactgagaattacaacaattcccaggagaagtaccacgtgacatacgcagtgcaggacagcatggaggagaagttagtcaccgccatcgccggaggggatgtgccggatatcgtcatgtgggaccgttttaccacggctacatacgccgcaaagggagcgtttatgccgctggatgactacatagcaggcgacaaggtggatatggaccagttttaccagcccacagtcgaagaaatgaaaggaaacgacggcaaacagtatggcgttcccctgacggtggatacgagaattctcttctataataaagaccttttaaaggaagccggagtgaatccggaggaaatcagtacgtgggatgccttaaaggccgctgcagcggcacttacaaagagagatgcaggcggaaagctggaacagtctggtttttccctgtcggatccggggcttttcaataactggattctccaggcgggcggaaagatggtggatgatacggtgacgccaccggttaccgcatttaattccgaggcgggactggccgtgctgaattactgggatgaactgctgaatcaggagaaggtctatgagctgggcttcgaggatggcttcggaggaaacggctttaaggcaggcaaggtagccatctgcttcaacggaccgtgggcgctcaaatccttagatgagtcgggaatctcctacggtgtactggaacagccagagggccctggaggagtgcggtccgcaatcatgggcggattcggcctggtaattccgagcaaggcaaagaatccggacgccgcctgggactttatcaaatggtggacgacacagccggaaaacggtgtggaatttgcgaagctcagtgccaatcttccagccaataaaaacgcggcggcagacgattacttcatgaacgacgagattttatccgtattttccaggaccatgctgtatgctacgacgagaatgccggttccgggatactccgatgtggaaggcctggcacttcggccgcagctggatctgtttgtgggcggaacgctctccgcagaggaggctctggccacggctcagaaacagggcgataagattttggcggaagcagcttccaaataacgcttcctgcgagaataaagaggagacagaacgatggcaaacttgaacgatgcattaaacctggcccaggaagcgctggagcgctgttactgggatgaagagaagcagtattatgagcaccattttccgagaaaagaggaggaagcctttgtatactggtggcatgcccatacggtggacgccctgctggacggatacctgcgcaccggggatggcgtctacatggaacggatcaggaaggagctgaccggtacctggaacgccaatcaccagacctttctccacaactggtatgacgacatggagtggatcgccctggcgcttctgcgtctctgggatgtgacggaaaacgacgcatgcagagaccaggtatttacgatctgggaagacgtgaagacggcctggaacgaccacatgggcggcggactggcctggcagaaaaagcagctggattataaaaatacgccggccaacgcaccggcggcggtcttggcattccgtttataccagagatttggaaggccagaggatttggagtggggcgagcggatctttcagtggaacttacgccatctggtggatcctgacaatggatttgtctgggacgggatcaaccggctgggcgacggaaaagtagactatgagtgggagtttacgtactgtcagggcgtatttatgcaggcagctctggagtattaccatattacaaaggatgaggcgtattacgagatggcgcttgccacctttcgggaggcaaaacggaggctggccgacagccacggcggtttaatcccatatgagggaccggatgactgcgggctgttccgggggattttcttccgttactgccgtgagctctatgcggaaaagaaaaatgagcccgagatccgggagatgattcacttccacgcggatactgtggcgagccggggaatgaaccgggaggggctgatcggcggcagctgggataagccggagacaggcactgtggatctggcccagcatctgagcggaatcatggtgatggagatggcggcaaggtgctgaccagggaacgggagccgtttgactcctgtaaggacacatggtattatataaatgatatatcatttatataataccatgcagtctggatgaaacgatagaaaacggcggggctgaaagagaaggaaggggagctttcttctccttggcccgtctgcgcacaggttgtgtgaagaatggaggaagtcatgaagggaaagccattatatgaaagaatttatctggagatattaaatgacatacggtcagggaagtatgagaccggtgtgcggctcccttctgagaaagaactgtgtggaatctataatgtgagcaggataacaggaaaaaaggcgatggatatgctggcggagcggaacattatcatccggatgccggggaagggatcgtttgtcaatgactcctgggagcaggcggcagagtcgcttccacaggagacaaagacggattctccggtgatcggtgtgatcatggacggttttggcggcagctacgggtataagctgattctgggaattgagaagacctgcagggaactgggatattacatggtgcttcactgtaccaatggcagcagggaagaggagagccgggcagtggaccggatgctttccctgggcgcacaggggatcatcatcatgtgcgtgcacggagagaattttaactcgactgtgctgaaactggcggtggaggagtaccccatcgtacttttagaccggaggctgaaaggcgttccggtatcgtacgtggggacggacaaccagaaagcggccagggaactgacggactggctcctggaccagggccaccggaatatctgctttgcgtcccactgcggagtggacacccctacgatcgcagaccgtcatctgggctttctggacagccatttagaacacggtctgaccacgaatgagtccatgtggctgacggatttaaaggcgacgctgccgtcccaccgcacggaggaatcgctccgcgaggactatgataaggtgaaggcgtttatcggaagccatccggatatcacggcatttttcgcggtggaatacgatattgccagaatcatccggagttctctcgtgcagctgggcgtggaggagaagtatacgattgtatgcttcgacggctatgacaatataaccggggaagaggaatttacccatatcagccaggacgagatcgccatgggacaaacgagtgtatcccttgtgagagatcagttaaatggcagccggaatatcgagccggtgctgattccgtataagattattcctgcgagcagttagtacagcgttgcgcaatgctgtaccaggaatttgactgagacagtttagcagccactaagatgggtgtaagaaaattttcaagagcactcacaggctgaatggaggaaaaatgatagagagaccggaaatactgacagagacagctgacgagctggaaaattactataagaaagcgtacccgccgctggcgccgcttgtgaaaccatgttttttaaataccattgatacgacagtaaagaagctgggggaagaggagtatttcgtaatcaccggagatatcgaggccatgtggcttcgcgactcctcttttcaggtgatgcactacgtgccgtttgcagcaaaggacgagaagctgcgggcaattctgcgtggcattataggaaaacaggcgagtcagattttgacggacccgtatgccaacgcgtttaacgaggttccggacggcagaggccaccaggataaaacgcagttaaacgactgggtatgggagcggaaatacgagctggattccctctgtgcgcccctttatctggcacatgcctactggaaggagactggctgcgccgatatctttacagaagaatttgagcggatgatggccgtactcttaacggtggtaaaaaccgagcaggaccatgataattcatcctatacctttgagcggtccgactgcccggagaccgacacccttccgtgcggcggactggggaatccggtgggacgtacgggaatgtcctggtctggctttcgcccctccgatgactgctgcacgtatggctatctgattccttccaatatgatggcagtggttgcgctggggtatggggaggagattctccggaaggtattaaagaacatttccctggcagaggaatatgcgaagacgaggaagcagatccaggagggaattgaagcgtttggaatggtggagcatccgcgctgcgggaagatgtacgcctacgagacagacggactgggccattataatttgatggatgacgccaactctcccagccttttagccatgccgtacttaaattactgcggctgtgaggatgaattttatgtcaatacgagaaaattcatactgtccggggataacccgttttactatcgcggcgcctgtgcggacggtgtgggaagcccccatacgccgcaggattacatatggcatattgccatcgtcatgcgcgcgctgacctcggctgaccgggaggagatactgacctgcctggagcagctggccggaacgcacgcggggctgaactttatgcatgagagcttccacaaagatgaacccacccagtttacccgctcctggtttgcctgggccaacagcctgttttccgcgttgatgctgaaactgaaggaagaagagtttttcgcgtttggagagaaataggatcgaaatatcaacagagttagtacgtaaatgaattgacacgcagtttccccagagaatcttctggtaaaggacggaagcctttgcggtgtgattgatttcggcattatggggacaggcgatcccgcctgtgattacgcaatggcctggacattttttgacagccaaagcagaaagcgttttttgcagggactgcacagcgatacgattgacagagcgagaggatgggcgctgtggaaggcgcttatcaccttgaatgcaagtttagaggaatagattcgcggatgtttttatgaggagagaccgggacaaaggcggaggcagaccggaattttgcggcgaaggcgtacagatttcagcaatggctgggaacgaaatctgtgcgcttttctgattgccgcggcggcttgtgcagagcgtgtgcgggagatcgttaaaactgtttgacactatttatggaggggaaagatgggattatcagttggagaggaaacgagattcggaatgaatcacgcggccgaagaggggccgaaggagagacggaaaaatgttatctggttcatcagcgaccagcacagggggcaggcgatgggaattcacggtgatcccaatgtgtcaacgcccaacatggactggctggcccgcaccggctgtgactttgtaatggcgtattccggcatgccgctgtgcagcccgtttcggggttccatgctgacaagccgctatccgcaccactgtgtgccgggccatgaatatccgctggatccgaagctgccgacggttgccagtgtattccgggaacatggttacgaaactctttacctggggaaatggcatctggctggatttcacgagagcgagggcagagcggcattccatctcatcccgaaagagcggagaggcggttttgaaaagtggctgggatatgagaataacaacagtccatgggattcctatgtacacggagacatgggggagggcgaggtgatgaagaagctggagggctatgagaccgacgcccttacagcccttttgctccaatatctggacgaagacagggagcggccattttttgcagtgatctcggttcagccgccccatgatccgtttattgcgccgcctgaatttatgggaggcaggagcagaggaagcgttgaattcaggcagaatgtaccgtcgctgcaaaaggtcagggaccgggcggccgaagatctggccgggtactatggaatgattgaaaatgtggactggaatctgggacgggtgatcggtaagcttcgtgacaggaagttgctggaacagacacatgtcatgtacttcagcgatcacggagacatgatgggatcccacggacagttccgaaagatgacgccttacgaggaagcggtgagaattccgtttttgattggtggagagattccgatggattacggtacaaggggctgcaaggcggtgaagcgggtgatgataaaccatgtggatatcgccccgaccacgctgggattgtgcggcattgagaagccagactggatggagggctttgattactccttctgccggttaaaccggagcgaaacgcacgacgatattccggattccgtatatctccagtcggtggcgcccaacgggggaccggacagcgtggatcagccgtggcgtggaatcgtgaccatggatggctggaagtatgtgagatttcacggaatgccgtggcttctgtaccacctaacggaagatccgctggaagaggtgaacctggcacacaacggggaatttcgggaaaaacgtctggagctggaggcacggctccgggagtgggaggaaaagaccggggatttcgagagctcccgcattgtaagagaggaaaaagtatgatatactttggagacaattaagagactgttataaggggggactgcggacgcggattccgcagcatatacggatgaaaaaatatattggaaacagggctttttatcggatgatacttgcgatcgcggtgccgatcatggttcagaacggaatcacgaactttgtggggcttctggataatattatggtcggaatggtgggaacggagcagatgtccggcgtggccatcgtgaatcagctgatgtttgtgtttaatatcagcattttcggggcgatttccggcgcgggtattttcagcgcgcagttttatggcagtggaaatcatgagggcgtgcgccatacgttccgctttaagcttatcttcagcgtcctgattatcatcgtggcgggccttctgtttctggtatggggtgaaggttttatatccatgtatcttcacggtgaagaggatgcggcggggctggctctggcgctggatcagggacgcaagtacatgctggtcatgattctggggatgatcccatttggcatcgagcaggtttacaccagcaccttgagggagtgcggagagacggttatccccatgaaagcgggaatcgtggccgttcttgtgaatctcgtcttaaactatatccttatttttggaaagctcggcgcaccggtgctgggcgtagtaggcgcggcggtagctaccgtgatatccagatttatcgaggcagggattgtcattcggtggacgcactgccataaaaagaagaatccatttatcacaggggcgtatcgcagcctgtacatacccggaagtctggtgaggcagatcgttatcaaggggatgcccctgatggtcaacgaggttctgtgggccggcggcatggcgacgttaatgcagtgttactctgtgcgcggactggcggcagtggcgggaatcaatatttcctccaccatcggaaatgtattcaatgtggtgtatctcgccttaggcaactcggtggccatcatcatcggccagctgctgggggcaggaaagatggacgaagcacgggatacggatacgaagctgattgcattttccgtgtgtctctgccttggaatcggcgctgtgctggcgcttctggcccctctgttcccgatgatttacaatacgacggatgaagtgaaggcgctggcgacggcatttatccgggtgattgcgctgtatatgccgatgggggcatttctgcacgcgtcgtattttaccctgcgttccggcgggaagacgattgtgacctttgtctttgacagcgtgttcatgtgggtggtcagcattccgtgcgcctacgtgctgagccgctacacggcggtgccgatcgttcccctctatttcgcatgccagatgatcgagattattaaatgcgtgatcgggtatgtgctggtgaaaaaggggatatggctgcagaatattgtggaggcgtagagcgcgtctaaaattgctttccgtcagctgcgctccaggctgaggaggcaggaacggcgtgccggacacggtgcccgggtcaggaggtcaggatgaaaaagaggagaggtgcggtaactttaatcggaagcggcaggccggaagtgaaggtgtgcgatatcataaatggaataccgaaggtgaaacgggtggaaaagggggagtatattgagttccgtctgaggtattccctgtttcacagagagatcaagcggtatgataaggagacttttgaggaaataaagaggcggtagggttagaggctattgcagagcaagtaatgcagctggacggttttctgtcattgggacggagggcgtttggctgttttttttcttgacgcgtgtgtgggagaggggggagataaaaataaaaggggttgacatagtaaatagttatatgttataagtaacatagatgaaagataacatacaaatgggatgacacataaagagatgacatataaagagatgacatataaagagatgacatatgggagcattgatgggtgaacccaacaatgcccgtccccaaccccaacgataagcggctaaaatgccgaaagaccgtttcatcatcacaaaggaggcttattaccatggtaacaatcgattacacaattttaggaatgctgagctggaagccaatgactggctacgacatgaagcgtatgatgcaggattcgccggtcatgtactggtcggggaataataatcagatctataaagcattggtacagcttcttgatatgggctatgttacaaacgagctacagtaccaggaaagcgcgcccaacaagaaggtttattcgatcacggacagtgggaagtcagccctggaagcatggattctggagacagagccggaaattccggagtttaagaaggcgtttctgattcagatttcctgggccggactgatggaaaaagaaaagattgaccaactgcttgcccggtatgaggaacaggtcagagagcagattgcaatgcggcaggaggagaagcggcgtcagaaatattttccaaaccggtctgagcaggagcactatgtatgggaccagatctatgataatctctgccagtcctatgaggccgaacttcaatggactgtccggttccgcgaaggactgaaggcattgaaatgacgactgaaaaatgcatgaaaatgaagtaatgaggaaaataccaggccccatcagttgtttgtcagggagtcaaccgttatttatcaagtagttatcggacagtcgcttccgaaataattaattacctggtaatagatctctgcatttaatgaacaaacaagtaatgaatcaccacaataaatcaaaagaaaggtagaaatatggtatgcagacagaaattataaccatgaatcaggcaaaagccgcagtcatttacagcgaagaatgcattctcaaggacgcacagtcggcgctggacttcattatgagtatcaaatatgagactgattgtgaaaggattgcgctgaataagaaggcgatcgcagaagagtttttcattctcagcacagggctggcaggcgaaatcttgcagaagtttataaattatgggataaagttagcggtctacggagatttttccagatatacaagcaagcccctgaaggatttcatatacgagagtaatcatggaaaggatgtgttctttaccagcgaccgggaagaggcggtaaaaaggcttaccgaaatacggtaagcccggagaagcccggtctatcggattgcctttgccggaacgcctgcaacaaccgcatgatccggaatatcccggatgacaacggcgccggcccccactatggtttcggtccctaccctgatatcgtcgatgatcgtacatccgatccctaaatatgcttttcggccgatctctgtgtgccctgccatggcggccctgggacagatattgacaaagtctccgatcacacagtcgtgttcgatgacagctccggtatttacaatgcatccgatgccaacagaagcgtttgtattaatgacggctccggccagcacggtacagccttccgagattacggcggagggactgatcaccgctgtggggtggaggagggatgccgggtgaagccctaaagaagccagcttcgcaagctttgcctcgcgaaggtcattgctgccggttgcgacgatcacttcatcataagtgctgagaatatcaaagagattctcgtctgtttcctcatagattttgtggccgggtatctgccgggtttccttttcacggatcgttaaaaaatcaatcacgtcatatcgtttcattgccagagcgcattctgctgttaccgttccctggtctccggctccccaaatcaataatctcttcattccaaatccccctttgacgtctgccagacagcaggaatacagttcttaagcgtctgcgcaattctggattcacactctttgcacctggtatcggcccaggggcttattcaaaataaccatctgtcctatgtaggttatcgtttgattttagcagtgatggtaatagatttatacctcataatagatttaccatctgagtatattttaccataaataaaagtaaaaagcaaacaaatgtttgacaatcggccgctgtctctctgaattactttggaatggaccggggcatggtctgtgatcgatcggatttcaggctcgcagcagccggaagactgggatttgtggtctgcagcaaggatcgggatgcttgtgcacggtatgtgacggtaaaattttaaggataattgcaagaatacctcaaactcaaacaaaactgaaacaaaactatgctataataagaaaaaaagtcggaaaaggaggatgaagatgcgcatcctgtaccagtggattggggacggaagccagagaatcagggaaaattataacgcgtccgacagcaggtccctgcacattacgggggcggcgggcgctttttgcatgctgctggggctggggaaaattatctccggcgcgctgtcgctttcggtgtttgcctgcatgaacggctgttataccctgggtatgacggcagcaaggtactgcgccctggcaggaactgtgcggtctaaggaacggaagaatcagtatttctattaccgtcttgccggcgccgtcatggtagccgccagcctgttgtatgttgcatattccctttggacaatccgccatccgaaaacagtcaattatggaaagatcacggctatcaccattgcaacgatcacctttacggagatcggtgtcaatgtatggggcgtaataaaataccggaagtaccattcccctctgcttcacgcgctgaagattatcagcctggggacttcgctgatctcgctggtgctgacccagtcagcgattcttgcgtttgcagatgaggctcaggatccgtcggtcaacggttttctgggaacggtaaccggaatctgtgcggccctgctcggtgtttatatgatccggcgcatcaaccggattgaggctgaggacctgtatagagaggactcttataaggaaaacacttaaaatatgaagggagacgatctttatgattcacatactggtggtagatgatgacgagaaactgacgcagagtatctgcagttacttaaataactgcggttatgaggcgaaaggaatgctgtctgcggaaagtgcctatgacgagatgtacagcagtctttatgatctgattatttctgatatcatgatgcctggaacggacggctttgcatttgccgaaacgattcgcaggctgaataaaagaatcccaattctttttgtcagtgccagagacgatctgtcctttaaacagagggggttcgatctggggatcgacgattatatggtcaaacctctggacttaagcgaactgctgatgcgggtgcgggcgctgctccgcagggctaatatcgaggccagccgcagactgacggtgggaagtctggttctggatgccgatgccatggagatcacacagggcgaacaggagattccggtgaccacgcgggagtttaacatcatgttcaaactgctgtcgtaccccaatcatacattttcccgctcccagctgatggatgagttctggggcgtggacagcgacaccagtctgcgggccgtggatgtctatatcacgaagctgcgggacaaattttccgcctgcaatgagtttgagatcaggacgatccgggggctggggtataaggcggtgctgttatgacgataaacaatggtacggaggatgcacgggtcacccgccgttatttcttttttcccgcctatgttgccctggtgtttctgctggcggttctgatgatgctgccgacgatcttctacggcggcgcccatctcatactggaggaatcaggcccctatataaaatggtactttctgtattgtattgttcttgcggctttcgtatccggcgggctggccctgcggaagtatctgaattttgaccgcccgattaagaagctgagcgctgccgccagacaggtggcggagggggatttttccgtctacattcccaagcgccatacctccaatgacatggactatattgacgcgttgtttgtggacttcaacaagatggtggaggagctgggatccatcgagacgctgaaaaatgattttgcggccaacgtttctcatgagttgaagacgcctttggcggccatccagaactatgcgcagcttcttggcaccacggaactgacgccgatacagcaggagtatacagaccggattctgtcgagtacacagcgcctcacgtcgctgatctacaacattctgaagctgaacaagctggaaagccagaaaatacagccgaagccggagccatacgatctctgccgccagctcagcgactgtgccatcggcttcgaggctatctgggagcagaaaaacattaattttgaagcggacatggaggaccgtgccgtgatcgaagcagatgaagagctcatggagctggtatggaacaacctgctgtccaatgcctttaagtttacaaaagtggggggaacggtgagcctgcaccagttttctaacggagagcgcatcatcacagaggtgggggataccggatgcggtatgacgccggagatgatgaagcatatgtttgacaaattttatcagggggatacgtcccattccacagagggaaacggccttggcctggccctggtgctgcgcgtcctggagatgagcggcgggacgattaccgtgaacagtacagaggggaagggcaccgtctttacggtctcgctgccccgcacagcactggcacagaaggaggaatcacagacatcatgacaagaatcagaaaagacggcgcggaatacgtgggatatgaatacaaggaaaagtctgtcccggcctcatttgcatcgctgtatctggacagttatccctgtttcggatgggaggaagatccaaacggtgtgagccgtaaagaaaatgcggaaaccgcgggccgtgcagttctgcgcttccggagagacagaaaaatctgcaacagggcggagctgacccgtctgcagaggaactttgacagctgtgtcgctgagatcgacgctctggagcagtccaaacgctcgggcgctgtcataggagcccttgttaccggaatcatgggaaccgcgtttatggccggctcggtgttcgctgttacggctgaaccgccgatggtggttctctgtattttgctggcggtccccggttttaccggttggattcttccatactttttataccgggcgctgctgaggaaaaagtcggcaaaggtatcgccattaatagaagacaagtatgaagagatttacgaaatttgtgaaaagggcagtgaccttttgatttgaaacagcatgagcggcagcttctcccgtaaaagtaaatgattacgtgagaagctgccgctttttaatattacagaaacaaaaatcaaacaagaaagaaatacagaggggctatactctctatatcccattgagaaaggcggtgaatgataatacacagacgaaagacagggcctgtgagtaagagcgatgacaggctgactctcatgctgctgttttatattgcggctgtctgcggttggctgtgggaagtactggtatactggggcacaagtggatttgctggttcgctgacggagcttttagttttttaccggggtgttctgcatgggccatgggcgccgatctatggcacaggcggtatcctgctggttttgctttaccgggcagtacaggagagaaagggatatttttttattgccgccatggcggtttgtacggtggtggaatatggaacctcgtggattctggaagtattcttccacgccaggtggtgggattattccgggcagtttttaaatctgcacggaaggatctgtttcgtcagcattgtgggcttttccctgattggactgtgggcggtacaggccgtcgtgcctgtctgtgccggatggattcaaaagctgacgtatgagaccagaaaaaggctctgtctgttggtatcattgctgttctttctggatgtaattgtttctgtttataaactcagcatttcataatgtaaatgcactgctcataacgggtgtcatgggagatgtagttgcgttaagagatactgtatttcggaatcggcgtattgccggtcggatcgtgaaaggagattaagatggctgaatatcgtttaaaacctggtaaagtcggggaaaaagtaataggtgcttatgagaaggtggagaagaaatttacggatgcatttctggaggaggatgcggtttccgattcaggataccgcttgaagacaggaaaaacaggagagtcggtcaaaggagcgtacaagaaaatcgaggatggcgtggtgggagcgtataaaaaggtggaagatgcctttgtcgatgcgtttctggaacgatgtgatgaggaggagagcggggaggtggacaaatgaataagatagcggttggtatggtgataacagccggcgccgcagttatggcggttgtggctgcggctgcggtccttcccagaaaaggcagtacgacactgcataaactcctgtgatgaagcagatatgtattttacttacaaagtattccgactggatttccagtctggtttactacatcggaggacaggggtatacccacagttcaattgcgctgggaggccagccgacacagttttacagctttaattaccgtggctttgccgtggaaacaacggaaaaacacaggcgtcggggagtccggtgcagccgcctctatcgcctgaatgtttcggataccgtctatgaacgaatcgaggagagaatccggtattttcttgaaaacagggagaactaccggtatacccgtctgggagtactatgctgtgttctccggctgccgttgtactggaagaatcattatttctgttctcagtttgtggcagaactcttatcagagtcgaaagcgctgcggctgtcccgcaagccgtgcttctacctgcccaaccattttatacgcctgttggagacacagccctgccttgcaggaatggaacaggatattatttaaaataaaaataaaatatgaaataaaaatattaaatatggaggttcaatatgaaaaaaagtaatttcgtagcattgattcttggcaccgtcggtatcgtattttttgcactgggaatgtgcatggcactggttgaagagtggggaatgttccagaaaggcatcatagccggtgtggccggccttatcattcttctgattactgtaattgtatggcgcagaatggaaggaaagagccccatcaggctgaatgcaaagaccgtcggatcggtactggccggtgtgctgggggcgctgctgctgggcgttggcatgtgcctgtgtatggtatttgacaaaatgattccgggtgtcatcattggcctggtgggaatacttgcacttctgatgctgattccgatgacaaagggaattcacgattaaatggattactgcagcagttttgcgttccggcgcttgccatggggctttgccgaaacacggaactgctgcgtatttttgtgcaggttttaaaatagagattgacattttcgtttctctccattatgatatatctaatagatatatctattagatatatagaagcttaattcagaaggaggagccatgctcgaatcattgatcctggggattgtatatgatgaagatttaaccggatacgatattaagaagaatatcgagaaaagcttcggagtcttttataaggccagctttggaagtctgtatcccgcgctcaagcggctgacgggcaaggattttgtgacgacgtatgaacagccgcagggcggccgtcagaagatcttttatcacataacggaagagggaaaatccagttttttagaatggctgtcgtcaccgatgaatattctggacggcacgaaccttaatctggcgaaagtatactttttcgacagactgccggcagagatccgggacacccagcttcttctgtatgagaacaacaatataagctatctgcgcgagctggaagccttagagaagagcctcagtcatatggatcatctcgacagctgttactataaaatgtcgactctttattacggaataagtgttacggagaagaccatcgagtggtgccgccatatacgggaagggaaagtgctgaaggaactgactgcgaaataggagcaggccagtatgaataagcgaaagtccggtgaggcggatcgggaaatgggggaaacttatgtcaggaaagtcaccgagcggtgctttaagcccttactattacaagggcggttattttcacggaattcattatggaagctattttgacgatgcggagtctctgtatagaatgattgagaaagaagagcgttttatcctggaatctccggaacggcgcaggattatgatcgatctctatgagacttctttaacgcctgaagtgctggaggctgtgatacggcacataggccggctgagtcccagaatcgtaaaactatccattgccgcggacaggaaaagtctgagagtcttacgctgtgccatgaaaaaggcgggagtattggacgacgggcggtattatctgtgcacggatatggaggaggggaagacctggcttgtcagcgaccaatcatgaacagaaggatagatggaagcactgtgtaaaacgccggggcagccatctgaagtttgcagtaaactgcatggatgattttgaggaggcgataggctggcttttatgataaccagatggcctgctccggcggatggagtgcaaaatagaaagagccggtaattcgaagttttataaacttctgaattatcggctctgcgtctttgcgtctggctcttttatgattgttatttgaagctgttttagatcaatcagactttcctgtctgcatttggggcagtacagggggaaattctttagttcggtgtcatctcttactttcattcgtgtcttgttcccacaaatcggacacagtaaccacatggcattcatcatttactctcacactcctaaccggcaattccatgtccggattatgcaaacatgggttccacacattcttttatgaagtccattctgtccccggtattttctttgaaaagagaagcgatggcgatgacaagctttttctcccggttgacgtaaattgtattaccgctgtctcccatggctgcaaatgcattatcatctgcgatccaccacagatatccgtagggcagatttaattcctcccaccggctgtgctcccttgtgctttcggcaatccactgggcagagacgatctgcttcccctcccatttgccgccgtctaagtaaagctggccgatcttcgccatgtctctggccgtgagcgtcagcccccatcccgccgcatgaatccccttcgagtccatcacccagccgcttacgtctctggcattcataaaggcgtagtgtgcttcttcattttccagggttacattgcctttcaccgtaataccgagcggcgcgaagagatgttccgccgcaaaatcgagcacggattgtccggttgcctttaccagaatgccggacaggatatccgggccaataaagggcgtatagcggaatttccctgccttttccggccctcccaataattccagcgcggtgcttacccagtcatcccttgtaaaatattccagatacggctcttcctgatgcttgtacggggcagtcattgtcatcagatcccgaagcgttatatcccgtatcgttgtttccccttcgttgtaattttcaaccgggaagtccgggaaaaagtccagcaccttctggttgacgctctggatttcccctctgtcggcggcgatgccgatcaggatagaaataatactttttgttaccgaaaaaatgttgatgcagctggcggccgtgcatccgttaaaatagccctcgtactgtgtttctccattctttaaaacaatcatgccggcagtattactgtaacgattataaataatctcttccaatgcagcgatcttttcctgattcatattgttcgtctcctttgtcattaggcgccgttgtcgggcagccatgatcaggtaccttttatcagatacccatttgttggtgtcgtttcagcctggttctgcctcctcaaatgatgggattacctcctcatatctatagggtaaatgcattaaaaatgtttttcaacaacttttttaaaaattttatgtttagtatcgtgaataaagaggaaaagggcacacttagctttttaacagcaggcataaagcctgcttctaaagagggccgtttctcccaccgtctgataccatttgacacgtattccttcaaaagttcaggaggaaactgcgtccctcaaacgccgatgatatccggctggaggttcgaaagaaccagggagatatgcgtctgccccatattccagaccaggagagagtatgaaatctatacagacaaaatttattacattaatattcaagcccggtagatgaattacggctgtagcgagccggcgtgcgatgcggaggtcatgttctccaggattgaacagtcggtcaaaaccctggcgggccggaattcgcggttgtggtgctggatattaataacctgaaaatcatcaatgaccgctaaggccttgaggacgaaacgcgtcacggcagaaccggaaagagagatatgattgttatggaaaatttcaatatgaaagagatgtccaagccgctattgtagaaggagagtgattttatggcgaagaaagccaatgaattaaaagtcaagaaaagcactgaaaaatcgtgattgacagataaaccaaaattggtttataataaaggtacaaaaaaggcagttcactccagcgagtggcttccaaaaagttatgtttctacaaaaatagtcacatttgctttggacggcgggtgactatttttttgtacctataatcataacgataagtaccccaaacgcaatcatcaaagaaagtgtctcatatgtactcatgttataccaccccctttcggagatggaagtcacccggcagtaggaactgcctgcgtttattatactaaatggaaatccgcttgtaaatggtataagtacaaagctatacttgtccatgctatatatttatagtaagattaacatatcaaaattaaacggagattttatcaatgactaacaaaaatgttaatactatcaaaatacttttcgtctgtcacggcaacatctgccgctcccccatggccgagttcatcatgaaggacatggtagaaaaacgccgtcaggccgaccgtttttacattgcgtccgcggctaccagccgcgaggaaatcggcaatccggttcatcacggaacgaggaacaaactgcgccagtacggtatttccacagagggaaaacgggcagtgcagatgacgaaggccgattatgacaagtacgattatctcatcgggatggagcagtggaacattaccaacatgatgagaattctgggaagcgacccggagagaaaagtctcgaggcttttggattttgggccgaatccaagggatatcgacgacccgtggtatactggagattttgattctacctaccgggatatctgtgaaggatgtgaggcgctgcttgactatattgacagatgtgagcctttaaaccgctgaaaatagcaagcctcctgttttccggaactaagcggaagggagaccttttatgaagaggggatgcaaaatacccctctattttcttgtgaaaatatactatcagttgtgatagttgtggatataaattgtgcattatataataagaaaaaagaaacggagtgaacagccttgaatcaatataaaggggaagcgtggctgggagaagagccacagatcagggaagaaaccataaccgaaacagtgtccgcggatatcattgtggtaggcggcggtctggccggagtggcggccgtcaggcaggcggcggagatggggcagaaggttcttctctttgaaaaatgcagatgcgttcaggccagatccggagacttcgccgtcatggacagcaaggtggcgaagcgctggggacgggatcatctgaataaaacagagattgtcaacaatctgatgcacgacatggcctataaggccagtcagaatattttgaaacgctggtcggaggaagctggaaaggcgttcgactggtacctggaggggctggaagatattgcggtcctggaccgtaccgatcaggtcccgccaaaaggcgtaaaatgctatgtacagccgaggcgtctgcctcttccggaaggttttgacaacgcccaggagaatttcaaatgctaccaggtgactgcatggatccgtccatcccatatcgccctgtgccgcggtaattttgaactggcggagaagacgggaaatgtgacctccttcttcaatacacgggtaaaaaagctattgaaaaacggtgacggccgggtggaaggcgtgatcgccgggaccagggaaggcggccttataaaggcttacgcctcaaagggtgtcattttggccacgggagattacatgagcgatgaagcaatgctgagacggttcctgcccggaatgatggagacgccgaagcagtggaccagctacgacatggaccggcagccatccaacacgggcgacggccataagatggcactctgggccggagcgaagcttcaggacagcccacacgcgccctgcgctcatcatatggggagtgtgttcggcgtagcggatttcctgcttctcaatacccgtggaaaacggttcgtcaatgaggacgcgccgggacagcagctgggcagtcagatcgagaatctgccggacaaaacggcgtggcagatcgtggacgggaactggagaagctatataccgaaggagtatccgaaccacggctctgtgtgcttcgtcatggaagatgaggagctggagagcgggacggtttatgataagctttgctttatcgacaactacatcgcaccgaagtatgtccggaaagcggtggaggatggcgttcttctggaagcggagacgctggaggagctgattgtgaaaacgggtcttcctgcggatacggcgcttgcgtcggtggaacagtacaaccgtctctgtgagcagggggaggacacggactacggcaagagaaaggaccggctgtttgcagtaaaacaggggccattttatgcagcaaaatttacaccggcagtcatgatcgcggctatgggaggaatccagagtgatgaggaggcccactgctacgacacagaaggagcgatcattcccggtctatacgctgcgggaaatgtgcagggaaaccgggtagccgtggattatcctctgaccgtgcctggcctgagccattcgctggctctggtatacggaagaatcgctgtagagagcgcggtaagggagagccggtaaagctccaaataaataaggcagacaataattcaatataaatatcaattcaatataaatatcaattcaatataaatagcaattcaacatatataccaaaccaacttaaatagcaaaaactgcgcagctgcgcatgaaaatggaggaaaaggaatcatgaaaaaagcaggaaaagctgtggtactgatgacggctctggcggtaaccggagcactgctggggggctgtgcgggcggcacggcggacagcaagacggaagcggggcagaccgaagcgggaaagacggaagctggtaagaacgcagaggattctgctcagacggaggctgccgggggaaatagcgcggaaggaaatgtaaaagaagatatccgtgtcgtcacgtatttcgcaggttccgatgcctacgcgccggtctggaaagaggtgtgtgccgattacatgaaggaccatccgggcatcaccatcgttgacgagtcccagccgacttcaggaagcaacgatttattcaagacgaaggttcaggccgatctggcagcaggcaatccggcggatctggtactttactatacaggcgaggcttatacgaagaccttcgaggactcagggctgttcgtggatttcggagacattttgaaggcagacccggaatgggcaggaaacttcaaggagtccccgctggaaaatgttcagtatcagggaaagcagtacgcacttcccttcatcggatattatgaaggaatgttctacaacaaggcgctgtttgaacagtatggactggaagagccgaccacatgggaaaatatcatgaaggcaaacgaagtattttcccagaacgatatcgtgacgctgtccatgtccctgggaatgccgtatatcaccacggaaaacttcattatgggcgcttcaggcaaggaaaaccacagaaattactttgacgacagttggggcattgccatcgactgcattgcagagctttaccagaaaggcggactgccgaaggacaccttcaccatctcagaggatgatgtaagactgctcttctcagaaggaaaagcggctatgatgatcaatggctcctggtgtacagagagccttcagggcaatccggacatgagaatcatctccatgccgacgcttccgggcggtacaggcggtgaaaactgtgcgattgcaggattttcctccggatggcatatgacaaaagcggccaatgagagaagcggagagactttaaaattcttaaaatatatgacatcaccggagaccatggccagattcatcgcctacggcggaagccctgccatcgtctgcgacgcaccggagaattccagcgaactcttaaagagtgcagtaaccatgctggagaaggcgcagtaccaggatgcggctctcgactctcaggtgaatcatgaggcgtatgagaccttaaacaatggaatccagtacgtctgcgaaggccagatgacgagcgcggaggtgctcaaacaggccaaacagctgaatgagtccggtcagtaaggcagacgggaaagacagtgatgaaagccgggggttgtgctcgaacgggtacagcctccgtgtgctcatagcaaggaggaaaaaacgtggcactgaaaggtaaaaaatatgtttggatctgcatcgcgccggccatgatcctgattatggcgtttttgatctatccactcataaagacggtaatatacagcttttcttcctggtataattttgcgcttaccagtgaatggattggtctcgacaattataagcggatcttctctgacatggtcatgcccgtggcatttaaaaatacggcaattctgatcgcgggcgtgctgattttccaggtgggatttgcgcttttgctggcgatcatggtggacagcgcccatcacggatttaaactgttccggacggtttacttcttcccgatcgtcatttccggtacggcgatcggcctgatgttcactctgatttacaagtatgaatacggacttttaaattactttgtcacacttctgggatatgataagcaggtgtggatcacgcctaagaccgcgatctatctggccctgatccctgttttgtggcagtatatcggcttctatttcgtgattttcttaaccggtatctccaagattccggaggatatctacgaatccgccatgctggatggcataaccccggtaaagaagattttctatattacaattccgatgttgaaagatgtgctggtttccaccgtagtgctcgtcgtatccggatgtttccgcgtatttgacaccatctacgtgatcaccaagggcggacccatgaattccagccagctgctaagcacctatatgtaccagactgcttttgagaaatacaacggcggatacgccagcgccatcgcggtggtgatgatcatcatcggcgtattgctgaccatcgggcttcggaagcttttgaaggccgatgtcgaagagtaaggagagacggcatgggaaataaaaaactaaaaatcagcagtatcctgttatacgcggttctcattttctggcttctgatcaccgtgattcccattctgtgggtatttgaaaattcgtttaagccttcggaagaaattctgttaaatggagtagcctttccgaaaagcctggatttttccaattaccgctccatcttttcgtatccggatgtgaatatgttccgctccttctttaacagcttcctgatatccggaggcgtggtagcgggagtggtctgtttcggaggcctggctgcattcggtctgggacggttcgattcgggagtcggaaaggtggtggaggccggcatggtagcctgtcttctggttccggcatttgcaactatgatccccaacttcgttacggtaagccgccttccgatccgggaaacgtacctggcggttatcgtcccccaggtggcaggcaatctctgtttcgccatcatgcttctgtcgtcctatatgcgctcccttccaaacgaactggatgaggcggccatcatcgacggcgcgggaccgtttcaggtcttaaagcacatcacggtgccgctgtcgaagcccatgtttgcaaccgtgggaatcatggtatttatctggtcctacaatgacctgattacgtccctggtctacatatccgaccagaagctgaagcctgtctgcgtgatactgaccatggtcagcaacatgcacggcacggattacggcgccatgatggcggctatctttatcacggtgatcccggttctcatcctctatatgatgtcccaggaaatggtcatcaaggggctgaccgcgggtgcggtcaaaggataaaacggtactgcagtgaaaaaaggagagtttggatgagagtatttgtcaatcatattggattcgacgggacggattataaaacagcagttctggagctggaacaggaggcagcggagataaccgcctggctggaagcggataacgtggaacggcatcacggggaacgatatcacgtggcggtgagcggcccggaacggattccggactggtcggagggctgctactacgttctggacttttccgatgtcagacgggaggggacgtaccggcttgccggttatgccgatgggaaggcatttcgatcggagatcatcacggtcaccggcgatttcctgagcctgcgcatggtgaatgcatccagagcttatctaaaaggggagcggtcttccggtgagtggatgaaggccgaccggaacgtgccgtttgcgggggcgagggaggggactatggatttacacggaggctggtatgacgccaccggtgactttggaatccatctgacccagctgtcccacacggctgtctataaccccatgcagtcccttctgccttcctatgtctgtttcgatattgcggaccggatggaaaaagaggagctaagagactgcagaatcttaaagaaggagcttctcgacgaggcgtattggggcgcggattatgcgatgagacttcaccgcgaaggcggcggatttatccgatcggtggaccggggggaggcgttttccgaggaacagcgccgttcggtggactatgagtatttccggttcagcgggcatgaagaggatgaaagctacctggcagagaccattgaagagaagcattatgagacgtgtatgcgaagcggagccggactggcggccgcggtattggcctccgctgcccggcataacggtgcttcgggggagtatccctgcggccggtatctgcaggcggcggaagagtcctttcagtatatgacggagcacaacgaacagtattccagcgacggaacctggaatttcctggaccggtactgtgccctggcggcggcagcagagctgtatgaggccacgtgctctgagaaatacttagaggagtgcagacgatttttccgcgggatgaaggacagcgctgtctctatggagcagggcgtctggttcacggccagggagggagaactgtatttccatccttctgatgagggatttcctctcattgccatgatgaaatacggcagtctggagccggatgaaatgcggagaaaagaggcgatggacctggtggcacaggcgtttgtccacgtgctttccatcagcggaaaaccattcggatacgcggcatttacacagaagatgggggagacagagaccagacggtacttctttcctcacgatacgaaggcggcgccctggtggcagggggaaaatgccagaatcgcatctctggccgcggcggcactccgtttttcctggcagaaggaagcgggggaaatgtccggtgcgctccgtaagtttgccgggcaccagctggactggattatgggatgcaatcccttcgacagctgtatgattgacggcttcggcagaaacaacattcagtatttcttccggaaccagtatgatttcatgaacagtccggggggaatctgcaacggaatcacgtcacgggaagcggatgacaaggggcttgaatttatcatggcccccaccgcggaatgtgacgacaactggagatgggcggagcagtggcttccccatgcctgctggtatttaaatgccatgggctggaaactgaaacgggtgaaatgatatggcttccaaatatattgaacgcaaacgaatattagtgaaaatggagaatatcgagcggtatcctctttccatcgttcacgcccccatgggatatggaaagactgtggcggtgcgggagtatttagagaccactgaggcggactgcgtctgggtctccctggcaggctcggagggggaagccgactatttgtgggcgagactgtgcgatgccttaaacgaggtgaatgaggaactggcggcgcggttttctgccatcggatttccctatgactgctttaaaaccgacgcgctcttagacgttctcatggactatgattataaaaaccatctgattctcgtattcgatgattttcacaggattgaggaaaacaacgtgtttgagctgataaaggccatcgtccgggagcggctttccggccttcatatcgtgcttatcaccagggaactggcaaaactggatgcggcggatttataccagaagcagctgtgcttcactatcacggagaaatccttaaaattcaaccgggaagaggtgttccagtacctggatttcatggaatgccggatgagcgaggaagaacgggagcgggtctaccagatcaccgacggatgggaatccatgctttatatcaccgcaaagggaatcaagcagggacttccggtgggcaagagtgccactgccgatgacatcattgaacagaacttctaccatgacttaagcccggcggaaaaggaggttctgtggcggctgtcggtcctgtcatcctttacgaagcgcatggcggccgcagtgctggataattcggagctttacgacgccttcgaaatgctcatcagcaagagtgtatttttcgtctttcatgaacccggccacacgtaccggctgagaaatatattaagagactacatctacgagcgcgccctgatcgaccgggtggattttacggaggtttacagaaagagcgggcagtggctgctggccgacggccagtactccaaagcctttgaatgcctgtaccgggcgggagagctggaggagattctctctattttaaaccaggatacccagaacgacaagggaatctggagcagcggaaatatccgccaggtgtttgaaaaggccggcaaggagctgtgctaccggtatccgttcgcctatttaaaatacctgctggcctgtgccatggacaggaagcgcaactacattccccgggtaaagctctgcctcgaccggctggaggaatactgccgcggttctgagtgcagggatgagatgcgggaaatggttctgggagaaatctgcatggtgcggagccggatttcctttaacgacatcgcagtcatggcggaatatgccagaaagggcgcggaatatttcggcggcggctgttcctgaatcgtgaccaaggagacggaatttacctacgggcttccctgtatgctgatgggatacgtgaaggagcagggaagtgtggcggaggtgcgggacgccttttgcacccaggggatgagctttgcggaatccaccgacggctgcggaattggctgcgactccctggctgcgtccgaagcggcgctggagacgggagcatgggagcaggcggagcttcacgcctataaggcgtattttaaggcgaaggcggcggagcagctgggcatcatgatttcttccaagctggtgttggaccgtctgaatctgatacaggggagcagcagggaccggatcctttcgaacagtacgttaaaggacgaggtgatcgcggccaacaatccggttttaaacaccacctttgatttgtgcggcgcctatattaacggatgcttaggaagggtggacagcattccggagtggatcaggaaaggggatatcgaaaagggaaatttcctctttcagggaaccggatttttctatgtggtctatggaaaatgcctcctgctgggaaaaaaatacattgaactggactccctctgcgaatccttttccacattcttaaagccgttccagtaccacctgatccggatttatttcatgatttatgagtctgtgacgaagagctatttagagagccgccccaggggcggggagatcttgaaagaagcgcttaagctggcggagaaagaccatctcatcatgccttttgccgagaatacaggccatgtcaggctgatgctggaggcgctgttaaaacgggaagagaatccctatatccgggaggtgctggaggcctgcaggcggtacagcagccagctgaagctttttcacgcctgcgaggtatcgctgacggaccgggagctggagattttaaagctgctggacgagggctatacccacgaggaaatcgccggtgagatctatatttccatcgccacggtgcggtaccacgtcaaaaatatctaccagaaaatggatgtgaacaacaaaatactggcgttaagaaaagcgaaagatctaaatcttatttaataaaggagaaacccattatggagagcaatgcgcatattgtagaatactggaagacacagccggaggtcctggaggcgtgtttaaagaacagcctgccgcttacggagaacttcgtaaagctgtataaggaggtcagcccgacccacttatatctggtgggaagcggcacttccttaaatgcggaggaaacggcagtctcctttatgaaagagatgctggatatcgatgtgatttccatgccgtcgtcctacgtacataatatccgcggagaacggccgctgctggtgtttctgtctcagggcggttcctcgaccaacaccttaaaggcgatggaggagatggcggcatatccgtatattacggttacgggggaagagacgtgtgagatcgcggcgcgaagccctcaccacatgattatcggatgcggggaagagccggtaggaccgaagaccgtgggctatacggcgtcggtcatgatcctgtacttgatggccatggaggcggcgagggccgtcgggatcatcggggaagagagatacgctgctgtccgcaccggacttttagcagggatatcccatatgcggtacaatatggaggccatttccggatgggcggccgatcataaggagaagcttaaggagattgaaaagtacatctttatcggccatggaacgggagcggccgcattaaaggaaggctgcttaaaggttctggaaaccattaaatatcccgcattcagctatgagtttgaggagtatttacacggcccgatcctcgcggtggacgatcacacgggagcatttctctttctctcaggaaagctgggagagcgggagcgtttcaagcggctggcagagtgtcagagcaagtactccgaatacaccttcctgattaccgacgaggagggggattcagacgaaaagacgttaaggatcagaaagacgggagccatgtacacggaagtcttcgaaatcgtggtgattccccagtaccttgccgctgtggtccagggatatctaggcatcgtggatgggtcgcccctgtacgacgagtatacagcgctctgtccaacaaaatacaggaatggtaaataaggtgacgatatggattacgtattaggaattgactctgggggaacaaaatttctcgtgaaagcggtgggaatggacggaaaggaactggcggagtacgaagggcatccggcggggctgtaccgtttttccagaaatgaggcggttcgcaccattcaggacaatttggaatggtgcatcggtcaggccgggctggcgaaagcggactgccgggcgatcgtctgcgggaccaccggcattgacagcgaagaggaccggcaggaggtggaggagatctaccggctgcttccgggattttcctgtcctgccctgtgtgtcaatgatgcggaggtggccctctatgcggtgaccggaggaacgggcgtcgtagtgatctcaggaaccggctccatcgcatttgggcggaatggcggcggcaggacggagcgcagcggcggatggcctccctgcatctttggggacgagggctccggcgcatggctgaatctgaaagcgctggagtacatgagccgtgtcctggatggaaggaaagagcgaacgctgctctacgacctgctgaatcaggagcttggaatcagcgggccaaaggatttaatccgcatctgccagagaatcgaacgggagaacaccggctttttaaaactgggaccagtcgtgatgaaggcactgagggaaggcgatgaaaatgccggggaaatcacccgcaccgaggcggagctgacctttgaactggcggattcggtggtgcagaagcttgaaatctggcgggaaccggagttcacagtcggggcatgggggagtgctatcgtgaaaaatccgtatcattttgaactctttaaggaacggtttctggagaaatactctaatgtgacggtgactgtggcggttcgtgacgcggcatacggggcatgcaggatcgccctcgatattctgggcggtgaaaccggaatctaccggttttaggaggcagctatgaagaagaattcatggtttcgttttctgatcctccagtgctgcgccgtgactgtcagcgtgtcccagctaaaggtctcggcagttatggagcaggtggcccagggcttttccatctccatgggcgctgccgccggactgatgtcatttttcacggtcgccggcatcgtgctggcgatacccggagcggctctgatggagcggatgggagcaaagcgtctcctgctccttttaatggcctgtctgtttgccggaaatgcagtgggggccgtggctggggcctatcccctgctgatggccggaaggctgctggaaggtgtggcttacgccatgatcatcatggttggcatcgatctgatcaacacctggtttccccacggcggcgcaggaaccgccacgggaattttcaatacgtttgcagcagtcggcaattttatcacgctgaatggcgctctgatggtagttaagagatggaatgtgaggacgctgtggtggatcggcgcggcgctggcggctgtggatcttatactggttttggcgtttatcccagcgagcaacgagccaaacggacacgctggcgcgtccatttggcgactgccgcgagggtcaaaaactccgctgctcgcagtgggggttttgactccggaggaaaagccaattccggaccgaagcaggagccgggagaacgatggtaatacggccgcgtcttccacgggagctatggtgcgtgaagcgtttcgggacaagcgtctcatgagcctgggcgcggctcagatgcttatggcgtttatcctgtttggatttatcacctgttatccgttgctttttaccggctactaccatctggcgccggagaaggccaacttctattccagcctgaatggcctgtttggcattccggcctgtatcgtatgcggaattctggcggaaaagaccggaaatccctgccgtgcggccatggttggagccgtgggaaccgttattgccggactcaccatgctgatcctgacacccggaacgtacgtggttcatgtgctggccagcgctgtattcccgggcggacttgtgatgacctccatcttctgcatggtgcccgccatcgcaaagcgaaaggagtcagttggctactatatggcggttgtaaacctgctgtactacacgggggtattttttgcaacgccggttatggtgaaactcatggaagtatcatggccggcggcagccggaaccgttgcggtcatggcggcggcatcgctcgtttttttatttcacagtaaggtacagcctgcgaaataaaaaccctccgggggatgcgcactccgcgctgtgcggcggaagaaagggcggcaggaagatcctgaaatagagttgacagctgattctgtatacgattataataagtgcagaaaaaggttcatttcggaaacgtgaaatgaagttggaaatcgtaacagttcagacatccgccgtctgaactgttacggaaaatcaacaaaaatagtcactgagcctgccggcgggtggctatttttttaggaggtagaccatggaatggagcacactgttatgtgaggacagaatcaggagtctggtgaagagaccgacgggaacggatttaaggacggagtttgagaaggattaccaccgcatcatcggaagcgcgtcatttcgtcgcctgcaggataagacgcaggtatttccgctggaccgcagcgactttatcaggaccagactgacacattcgctggaggtatcgtcatttgcaaagtcgctggggcagaatatctccgccagcatccggaccgtgattaaggatgagtcgtttctgccggagcacgcactggccatgtgcgatattttacagtgtgccgggctgattcacgatattggaaatccgcctttcggtcactttggagagaccgccattcaggactggtttaagaggagacttcccgagctgcgctttcagaggagcggagaggaggaggcgcggccgcttgacgaggtgctgaaccgccagatggtggaagatttctatcattttgagggaaatacccaggcgctccgggtggtgaccaagctgcatttcctggtggacgagcacggcatgaatctaacgaaggcgcttctggcttctatcattaagtatccgggatcgtctctggaggtggataagcacagcggaaacatcaagacgaagaagatggggtatttctatgctgaccgggaggcatttgacgatattcaggcttcctgcgggacgaacggggccaggcatccgctggcatttattctggaggcggccgacgatatcgcctatgccaccgcggatattgaggatgcggtgaagaagaactgcctgaccttcgagcagctggtccgggaactgacggagtataaaaaagagtgtcagaatgaacggtaccgcgatatggtgtcatggctgacggacaaatacaaccgggccgtgagtaagggctacagccgcccggatttatatgcggtccagaactgggtggtcaccatgcaggggcagatgatcggcggggccacggaaggctttaccaacaattatcaagagattatggcgggaacgtataagaaggagctgaccgcggggacggatgcgcagcttctcatggaggcgctgggagacatcgcctaccggtatgcgttcgtgtccaaaccgatcctgaagctggaaattgcggcggagactattttcaatttcctcctggataagtttgtggacgcggtgctttatttcgatacgggaagaaggcagagcgcggtacaggagaaactggtctcgctcatctccgataattacaagaagctgtattttatctgttcggatgggaagcgcgaggaggagaagctgtatctgagacttctgctggttaccgattatgtgtgcgggatgacggacagttatgcgaaggacttgtatcaggagttgaatgggattgcgtaaaaagcagggagtaaagcagggactgaatccaaaaagtccttgctttttcccatcatatcatgtatgataaaaaaataattcttataaaagaagattagaaggagtgtagtgtatgttatcggtagaaaaggcagctttcctctaaaacagaatacggcggagcgcagcaggaaaccggagagaataccggtgtttttgtggcgtgatccactacctttcgtgaatactgtcgcgctgtgcgctttgcaggacacgtctggcgtgtctttttttgtacccatttttaaacgggcggcatgacagaataatcccgcggagacagactggaaggtttgtttccgcgggatttttgcgtctgttttgaggaaagtaatgagcatcagaaggagaaaaaacaatgagagagaatggatttttttatgagaaacgaagtaatacggaggctgacagaaatgaatatagaacaatatggataccagaaagcggatacgattgactgcgggacaggaattcccgccagagtgacagcagttcaccgctcccattttgaaatcgtctgtgacaggggaacgggactggctcgtttaaagacgggagaatactacggcggtaatgagaatgtccccgccacaggggattttgtgctcgtaaactggcaggagggcagtgaaagcctgatattaaagacgcttccgcgaaagacgtattttgcgcgtctggatccgtcctcgtcgggatacggggaacaggtcgttgcagccaactttgattatgtctttatcatgcaggctttggaccgggattttaatccgcggaggctggaacggtatttgacactggcatggcagtcgggagcgacccctgcggtgattctcacgaaggcggacgaagcaaaagacccggctgtccacgtacttgcggctgaaaaaatagccgccggtgtcgatgtatatgcggtcagtgcgaaaactggccaggggatttccgaactttcaaaatatatgaagccgggccggaccacagtcttccttggttcctccggggtgggaaagtcgacgctggtcaatgccctcgccggagaagcgattatggaaacgggagcgatccgggaaaaggacgggcgcggcagacatacgaccagtcaccggcagctggtccttttaaagaatggagctataattattgatacaccggggatgcgggaacttggcatgtgggatgtcagcgaagggctggggcagagcttcgccgatgtggaacagtatcttgggcgctgcaggttcaatgactgccgccatcaaagggaaccgggctgtgccgtcaaggcggctatccaaagcggcgaacttcctgcaaaacggtgggagagctatttgaagctgcttacggaagcaaggtttgccgacgataaggccggctatctgaaggaaaaacgccagtggcacaagagcatctcgaaaatgcagaagtcaggaagaaatgcagattacagaattgaaccgtgcacggagacatttacctgccgggcctgcaaaaggctgatcgcaccggaagacgcgggaagcagccaccgcaaccactgtccgcactgcctgaccagcattcatgccgataaccagccgggagacagggcgtcgctctgtaagggaatgatggagcctgtcagtgtgtgggtgaaaaagaacggcgaatgggcggtcattcacaaatgcagatcctgcggaaccctaagctcgaaccggatagccgcggatgataacatgtatctgctcatggagattgcaatgaagccattgtatgcgccgctttgccggccgggtgaggcggaagaagagggaacgaaaagcgcagaatcagcagcaaaggcaaacagccgctgtcaggtatgcggctccccagtgaacctgggcggagaaaaacgcaggcattgtcctgactgcctgtccggcgttcacaccgatgaggaccggccgggagatggggcatcgctatgcagaggtgttctagagccagtcggcgtgtgggcgagagaggatggacggtgggagatcattcaccgctgccgatcttgtggtaccttatcatctgatccggtggccgccgccgataacacaacgctgctcctgtccatcgcaatgcggccgctggcatcgccgccgtttcctttatggcagctgagaaaagaaccggcggactgatcggaggccagggcgtcgaggcgaataaattccgtgagttgagacgaatatatttcgtgcattgaggccaatatattccgtagatcaaggcgagtaagccattgcagccagtcgcaggattccaatccatgcagatacagatatgataaagattgtcagaaaaatatcaaaaacattattgcaggtataaggtttgttttgtataataaagatagatcacggcgtaatttttaaataaggattgtgaaaaatgataaaactgacaaatctggatgtgaaaaagatgacgattggccagatggccagaatgaaccatatttcggagcagacgctgcggctttacgaccgggagggcctgctctcccctctgggacgggacgaaaaaaacggctaccgctattatgacatccgccagagcgcccagctggatatgatccagtatatgaaggctctggggatgccgctgaaggaaatccgggtccatatgaaaaaatgggacaccgggcgtttaaaacagctgctggtggaaaaccgggatgccatcgaccgcagaatcgaggagctgaatttacagaaaagggcgattgagcggactctggacagttacgagcggtatgaggcggctccgccggacggttcgatcgtactggaatatattccaaagcgccagatgtacgtaaagaacacgaatgtgaacttttatgactatgaaattgacgagtatgagcggattcttcgggatttgaaagaggatatggccgcacacgccatctcgccgttcttcttcgccaacgcgggtaccatcctgcggagagagaatttcatgaagcggcgtctctattctgcggaggtattcgtgtttgtagaccgggagtacgtggacgaggaactcataacggtgatcccgcccagcccctatctctgcatctactgtgaccggtttgagaaggaaaaggagtacatcgaccggctgctggtagagatcgaagagaagcattataccgtgaccggagactatatctgcgaggtgattgtggaaatgcctctggattacacggagcgcgggatgtttctgcgcctccaggtgccgatccggatggggtaagactgcggaaactgcgcatgaatccggcatttcagccagatccgatttggtgatactgctcaattgacctgataccgtatataagccttataatgaaaccagcaaatggggcatagccctgaaactgtcgactttttataagaaaggaagcgttttttatgatgaattatgagaagattcgtgtagtacagtatggctgcggcaagatggcaaaatacatcctgcgttatttatacgagaagggcgcggaaatcgtaggtgctatcgacgtgaatccggcagtagttggaatggatgtcggcgaattcgcagaactgggatttaagattggtgtgacaatcagagacgatgcggatgcggttttagacgagtgcgacgctgatatcgcggtagtgacgcttttcagtttcatggatgactgttattctcattttgaaaagtgtgtttccagaggcattaacgttgtgactacgtgtgaagaagcgatctacccgtggacaaccgcttcctccattaccaataaactggatctgcttgcaaaagaaaacggctgcaccatcgtaggcgccggtatgcaggatatttactggatcaacatgatcggctgtgtagcaggcggcgtgcaccgtatcgataagatcgagggcgcggtaagctataacgtggaagattacggtctggccctggcggaagctcacggagcaggactcacaccggaagagtttgaagcccagatcgcacacccgacgactctggaaccggcttacgtatggaactccaacgaggcgctgtgcaacaagatgggctggaccatcaaatcccagagccagaaatgtgtaccgtatttctatgataccgacctctattccgcaacacttggaaagacgattccgaagggcaactgcatcggcatgagcgcagtcgttaccacagaaaccttccagggaccggtgattgagacacagtgtatcggcaaggtttacggaccagatgacggagatatgtgtgactggaagatcatcggtgagccggataccacattctatgtaacaaaaccggcgactgtggagcatacgtgtgcaaccgtggtcaacagaattcctactatattaaatgcaccggccggatatgtaacggtggagaagctggaagaattacggtatctttcctatccgatgcagatgtatcttgataattaacagaataacggtatgaatacatggggtctgccgcacggaaagaaagtgcggcagatccctttttaattacgcaatacgttatactagacatggcggaacagaattttcggtcaggggccggatcagatggctgggatttaacagacgccttatgatggacaatggaaataaacttatgtataatggaatctgtatggtcagaaacgacagaaagctcctttttgttttagaagcatccccgtgccgggaaagcaaaaagcatatttctgacagtagaatatatataaattttaccgcaggcagagtgtggagaagacggaatacatactatcccgcaggggggaagaacgtttttggtgagtaggatgaaggaggaaaattatgaagacaatatttctgttgatggattccctgaaccggcattatcttaattcgtatggctttgataaggtgaaaactccgaatattgaccggcttgccagccgcggaatcgtatttgacagccactatgcgggttccctgccgtgtatgccggcccgcagagagttaatgactgggcggcttaatttcctggagacaccgtgggggcctgttgagccgtgggatacctgtatgccggtagagcttcgtgagcaaaagggaacgtactgtcacatggtaaccgatcattaccactattttcatagcggcggcgaggcgtatcataccttgtttgacagctgggagcttgagcgggggcaggagggggaccgatggcatccgctggtaaaggagccggaggttccggaatttaaaggtaaaaaccgcagggcatactgggtaaaccgggagttttatgaccgggaggatgaaacccaataccctacgccgagatgctttatgagaggtatggaattcctggaaaataactgccgggaggataactggcatctccacctggaagtgtttgatcctcacgagccctttgtgtgtccgaaaaaatataccgatctgtatggtgaccagtgggaaggggagtatcacttcgactggcctccgtaccaggagacagaggaaggaccggaggccatagagcatatccgcaggagttacgcaggtgttttgactatggcagatgtctggcttggtaaattcttagataaaatggatgagctggatctgtggaaggataccgcggtgatcttcaccaccgatcatggccatctgttgggggagcacggttactggggaaaaaactatatgtttgattatcaggaattagcgcatattccactgattatctgcacaccggaaactgcatattgccatcggcgggtgcctgcattgacggcgacaatagatttaatgccgacgatcatggaactgcatggagcccagataccgcctgatgtacacggaagctccctgctcccgctgttggacggcagtgaggagcggctgcgggacagtgtgctgtatgggtattttggaaaagatatcaacttatttgacgggcgttacagctattgccgccaaccggcggagggatcgaagctgtatcatcacacattgatgccgcgcagctttaacgattttctgtccccggagcagctcgcaaaagcagagcttggattttatattgagaatcagaaggccattccgcagctgcgcatagaggcagaatcctacagacataaaaacgcaggggagtccaacctgatctacgatattcagatggatcctgggcaggaacatccgattgaggacagcgaactggagaataagcttgcagagaaaatggtacgtcttttgataaaatacgatgctcccgaatgccagtatcagagaaccggtttggagcatttgcgctctttgggattcagtgttccatgacacacagaaggagaataaaaatgaagtttttagaaaagcatcccatgattatgattgtgatcggcatcatcggcatatccctgtcggcgatctttgtgaaatattcagaggcaccgtcggtggtgacagcggcttaccggctgctctggacggtggcgcttatgactccggtggtattgggaaagaaggagatcaggcgggaactggcgggatcggataagaagacggtggtactctgcgcggtcagcggtattttcctggcactgcattttacatcctggttcgagtcgttaaaccagacgtcggtagccagttccacggcgatcgtctgcaccgaggtcatatgggtggcactcggcttctgcgtgttcttaaaaggccggctttcaaaggccgcggtgggaagtattgcggttacggtagcgggaagcctgctcattgcactgtctgattattccgcaggcggaaatcatctggccggcgacgggctggctctggcggcggccgtgttctccgctgtctacacactgatcggcagagaggcgagaaagcatatgtctacgaccgtttatacgtatattgtatatgtgttctgtgcgctggtgctctgcatttccacggcggtcagcggcctttcctttacggggtacggcgcggcttccgtggtggtgggacttttactggcggtattttccacgcttcttgggcacagtattttcagctggtgtctaaaattcctgtccccgtccttcgtatcagcctccaagctgtgtgaaccggtggtggcggccgtattcgcagcggttttatttgccgagattccgacgattctggctgtggcaggcggattcgtgacgattggcggtgtgctgctttattcccgcgagcaacgagcccaacggacacgctggcgcgtccatttggcgattgccgcgagggtcaaaaatcccgccgattgcggcggggtttttgactcgagagttgaatcgcacagtgaagcacaggagaaaacgtgatatgtgactttatcacggaaatgattttgtatccccgctataattacctcatgataaaaacagagaggtgaaccatgcgatgggaaataaaacagtaattatcggaggtgtggcgggcggagccacgacggcggcccgcttaagaaggcgtgatgaaaagcggcagatcattctgctggagcgcggggagtacatctcttacgcgaactgcggacttccttactatataggcgatgtgataaaaaacagggattcccttcttttacagaagccggaggtcatgaaagcccggttcgatatcgatgtgaggacttcgagcgaggtgacggccatccatacagacagaaaatccgttgaaatcaaggataagaagacaggggagacgtacgaggaatcgtacgatgatcttgtcatagccacgggatcatcaccgctggtaccgcccattccggggattgacggaccggatattcacactctgtggaccataccggacacggatcagatcaagcaggtgctggtggaaaagaagccgcgtcgtgccgctgtcatcggaggaggctttatcggcctggagatggcggaaaacctggtccatgcagggggggaagtgacgctgatcgagatgcagaaccaggtgatggcgcctctcgaccctgagatggcggaactgcttcatgagaatctgaccgcaaacggagtcagactggttctgggagacggtgtgtcctcgtttgagcggaaaaacggccatacggtcatcagactgggaagcggcaaaaccgtagaagcggatctggtgcttttatccatcggtgtacgccccaacagcagcctggcgaaagaggccgggattaccttaaatcagcgcggcggcattgtggtggactctcatttgagaacttctgcggatcatgtctatgcagtgggagatgtgatcgaggtggagcactacgttctcggaacaaagacgatgattccgttagcggggccggccaacaaggaagcgagaatctgcgccgatattctggtgggagacgagaaggaatacaaaggaaccatgggaacctcggtcgccagaatctttgactatacggcggcgctcaccggagtgaacgaaaagacgcttagatccatgggaaaggtgaaagggacggattatgaaaccgtgctgattaaccagaaatcccatgcgggctactatccgggagccgtttccctgatcctgaagctgatatttggaatgaacggagagatttacggcgcgcagatcgtggggcaggagggggctgacaagcggattgataccattgcctcggtcatgaggatgaaaggatctgtcagcgatttagaggagctggagctggcctacgcgccgccctattcttcggccaaggatccggtcaacatgctgggattcacagcagaaaatgttttaaatcattacgtatcatttatgagctgtgacgagctggaccgcttatcagcctctgaggcggagggtgaccgtccgctggtcctcgacgtgaccgaggaggtggagcggatggtgtaccatataccgggttcgtaccacattccgctggggcagcttcggaaacgcctaggagagctggaccgggagaagcagattgtcgtatactgcgccattggagtcagatcgtataacgcggcgagaatccttttacagaatggatttgaaaatgtgaaggttttggaaggcggtatttccttctataagtccatgcatcaccgcgatttcgaggaaaaggaccgggaagaaccggatcagggagagcaggtggaagagagggaagtgatgagaaaatccgtgaaaattgtagactgctgcggccttcaatgcccaggcccgatcatgaaggttcatgaatcgatcggtgaaatggaagatggcgatattctggaggtctccgccacagatatgggattttcccgcgatatcgcatcctggtgcagacagaccggcaacaccctggtggggacagaacggaaggggcaggagagcatcgttctgatccgtaagggaatggagaaccgggaagctgagcaggagacgaatcccgccgcttttcccgcacctaagggaaaaacgatggtagtatttgacggcgatatggataaggcgctggctgcatttatcattgccaacggcgcagtcgccatgggaagtccggtcaccatgttctttaccttctgggggcttaatatcttaagaaaaccggagaaacgcaaagtggagaagtctctgattgaaaagatgttcggagccatgatgccgcggggcgccggaaagctgaagctttctaagatgaacatgggcggtatgggaaccagaatgatgaagaaggtcatggcagataaaaacgtggattcccttgaaaaactgatgaaccaggccatgaaaaacggcgtaaagctggtggcgtgcaccatgtccatggatgtcatgggaatccggaaggaagaaatcatcgacggcgtggagtttgccggtgtggcgacgtatctgggcgacgcggaaaactcgaatgtgaacctctttatttaacaaaactttggttgactgcaaaaggatcccgtgaaggcatggaacaggcctcacgggatccctttgcagtttttaaacagtatcctttacttctcatttctcccatttccactcatcataagagcagcgaagctttttctctatctccgcagcttcccgtgtacctgccagattaaattgttctttcggatctttgtttaaatcaaacagcagataaatctcctccgcctgattaaatactgctttaaatgaatcttccaacagcatcgtctcaccgaagagctgtgatatcacacgctttttggcatttccggtgccgctcataagcggcagcagggagcaggaatgtcctgtttcctgggaaattcccagtaaatcgcagagagtagctcctaaatctatcagctcgaccggagtatggatgctctggccattttgtgagggaatggaaatcatcagcggtatcctcacggaggtttccaaaaaggtttgtttaaaaagaagtccgtaatcgccgttttgttctccatgatcagcggtaaatacaatcactgtattttccagaagtccgcgcttttccaggcagccgatgatccgtctgatctggccgtcaatcagtgtgacatggccatagtagctgcggcgcagtccaatgatatcctgctccgtcatattccgcacatcttcagtgaggccgggatcgtattttccatttaaaatctcatcatatactcccttcgggcgattgggatttaaggaatacggtgcttttaagggagccggcggcgtcatattccgatagagatccgcatattctttcggcgtatcccagggatcatgcggtcctccgaagccaacggtgcagaaccaggggctttcctttgaaacctgttccaggtactcgaccgcacggtccgcgatatacacgtctgcataatcggttacctccaaaggtgttggactgcagtcatatacgtggcctttttcataccgtttttccatgtccctgcaatagcactcgagcagccccttttccttcaggtaatcgtagtagctggattttttaatcccatatgtacgcggccccggcagctcatctacgatgttgtagccataccctttcgtctgccattccatgtctcttaaatcagaggcaaatttatgaagatgcgcttttccgaaaagagaggtctcatatcctgtatcccgaatcttctgcatccaggtcttcgattccggcgtcagaccggcacagaaattgtcatcaatccccagctctccgggatagaggcccgtcgccagcgacgcccgtgccggcatacacaaaggtgcgtttgtataacagttcgtaaaccgtatggattcttttgccaattgattgagacagggcgtccggatgcctggagttatgtaacccagtgcatcgtaggcaaactggtctgccatcaggaataacaaattttttctcatctaatgtctccttgtcaaagattctgccagccgttcaaaacttctcccggccgctgtctctcaataattcctctcttttaagaacgccccgttccgtataataagggatatccagctcttccagcttcacgacgctttcatgagccaccgcccgttttacttcctcctccaggctcatatagtcaccttcctgtctcttggaaaacagcggcgggttattttcatgatacttgaaccgcttgaattcctcctgttccacaaactggccgttttcgacgtaacctttcagtccatactgcgcctcaaatgcggtcagctgagcttttaacttctctttgaccacgagcgtttcggcgtccgggtcatgataaagcagatttgtcgtttcatccggatcagtttccagatcaaacagttcttcttgaccgcctccatagtagtaattgtatttatagttcttcgttataaggcttatccagcgcagctttccgtggctgtgttccacatattccaccgttctgtcctttctcccatcctcagcgaaaatcgattcgcccggcaatctctcaggatttggataggaaactcccgccacgtccagaacagtaggaagaatatcgttgatatcaacgaatctgtcgtcattacttccggcttttagcttgtccggatacctcataatccatggaatccttacagagccgccatacggaagcatcttctggaaggttccgtgatcccctaacatttctccgtgatcgcttgtaaagagaatcagggtgttatcatattctcccatatccttcagctgctgaatgattttaccgatattataatctacaaatgagacagacgcataatagagttctcttgctcttcgaagataagattccctgggatagtctgcaacatactttttccattctgcaatctcggaaatcggagttttcgactcctttaacggaggaagctcttttcctttatagagatccgcccatttttccggtacatcaaagggcggatgaggcgctataaagctgctccacaggaaaaatggtctctttcccgcattttcctgcagatggtaaatactcctttttgccacccatgtgctgccgtgatgctcttccggaatcagggacctctgaggcagcatatataacagatggcgtactccatggggactctgcaaatgtccatacccgttttcttttaaatactttgtgtattcatcatcctctaagtatcgcgggatttcttccatcagctccattttcgtaaatccgttatgccttctgcacggctgaaaatgcatctttcctatcgcaatcgtatcataacctgcatcggacagcaattgcggaagcgtcgggagatcgtaagggatcatcttgggatcactttcaaaatagttgtcgtcaaatccgtgatacctggccgtcaggcctgtgatgatctggtgcctggccgccatacagacgggattgctggaaaatgcattgggatagcagcagccttccgcagccagcagatctaagttgggggtctccataaagtcatatcccatggcgcagatggtatcgtatctctgctgatctgtggtaatcagtaatatatttggtcttttcatccgttgtctcctctttataactgtgcccgttcgtctaaagcgtgcctgatttccatgtttctctcatctgtcagctcgtagaagtgcatcgaaagcagcgacgcaatatatcctagaatcgggattccgaatcttaagacaacgatgataaacaatacggtctgtgtctgttcctgattcgcggcaaatccaaatataccaagcaggtagctggccagaaacgcgcctatggcgccgcagaatttattcataaatgaaaacgtggatgacacaacgccatttcctttgacaccggtgacatactccgcataatccacacagtcgggaagcatcgcccaggccagcgcactcggaaccgtggaaataaggccaaacagggtgatcaggacgatcaatgcagcgctgggaaccactggttttagcaaaaggacagccagcgggacgatggagaaaagacttccataccagtaaagtctcttttttccaaccttttttgttaaaaacgggatcgccaggttggacaggacgcctgtcacggtcaatgccacggaagtgatgggaactaaatccactcttcccaggacgtatttaaaatagtacatattgactgctaaaagtgcggagtttgcaatcatatccgtaccaaaagccgacatcagcatgagcagcggtttgtttttggtaatcagctgcgtctctttcagcagattgaccttcggcctttcaatttttaaatcgatggtatcatacggcttcagcccccacgcgacacaccagaagcacagggtaatgagaacgcccaccaatgctccgaatcgcccccagccggtggctccgccgccaaacacctcgactaacggcaaggcgaatgttgtaatgaaaaaacggcccacctgaatcatgacatttttccatgatacgaccatggttctctctgtggagtccttcgccagaaccggaaccagtgaggtaaacggaactccgactacggtgaaggccagtgaatacagtatgtagactacgtaaataaataccactttcatggtggaagaaagctccggcgcactgaacagcaaatagatcagcgctcccaaaaccggcgcaccatagatcaagtatggccggtaccgtccctgcttcgtcctggtctgatccgcaagaaagcccatgatcggatctgttatggcatcaatgcccttggtaacaagcatgagacctgccaccgtcaaagaactgataccgaaaatgtcggtacagaagaacgtgagatataccattacgatttgattggtcatactaaatccgatgccgcctgccgcgtattttccgaaattgaaataatccggccttccaaatttcttactccctgcatgtttccccattaaaatatcctcctcttacctttccactactgtgtaattgctttcgctgaaacccattttataggatttttccagtcagttatgatgccatttggcacactgggaatatattgtgtatattgtgtaatctgagaacttgaaattgtgcacttttactatatggtggcctctttgccgcacgattctgcaatcgatgattgcggtcacgtttttcgacagaaagtgctataatgattataacaaacattttcaaggagtgaagacgctatgattaatacgaccgaaaatactctgtatcaaatcatgcagttcgtacaggaacagcacagactggggaatccgctgaccagtgacattataaatccatttctcaatcgtatgctcaccgtacgtatggttccgaaagacggatatatcactacggtccatacaccgataaaaaaagtctactacgtcatgtcggggtctttctccatgataagaagctctgttgacggaaaaaacacgattcggattcaaaaggctccaacatttttaggggttgactttaccgtactgtcccttaccggttattttgcggacaatcttgcactggaggactgcctggtccttgaaatcgatcagaaatattttttagagagtgtgaaacaaaacggcgagatgtgttatgaggtcttatactcgatctgcagcaagttttttcaaacgtctttccgctatgaccatacgcttttctacgatccatgtacaaagcttatgatctatatcatggatcactggattaccaatcacagacagcagacaaagtacacgatagcggttcccaatacccgcattgccgatgagatcggcgtcagcataaggacgtattatcgcgcggtcggcaaactgaaaacagaccatttcatctccatagctgccggcaatatctgcgtaacctatgagcaaatacaacagatcaggtcctatctgcaaaatgcaaaggcggtcacagcgctgccggccttccttgaaaatagtacgctcgtgtgaatgattgagattttatcctgaaaaatgtacccttggccataacagtgtgatacaatttatagaaatgaaacagaatctatttgtatacaaaggagatagtggatatggcggaggtaacactgggaagaaccatgattacggtgaacaagaacggcttcggtgcgctgccggttcagagggtttcggtggaagaggcggggaggctgttaaaaaaggcgtttgatcatggaattacatttttcgatacggccagggcctacagtgacagtgaggaaaagctgggactggcatttgaggggattcgtgaaaagatattcattgccacgaagacagcggcaaaaactgcggaggagttccggcgggatttagaggagagtctgcggcttctgaagacggattacatagatctttaccagtttcataatccggcagtctgtccgaagccgggagacggcagcggtctttacgaggcgatgctggaggcaagggagaacgggaagattcgtcacatcggcattaccaaccacaggctgaatgtggcggccggggctgtcgcatcgggtctttatgagacgctgcagtttccattttcctatctggcatctgaaaaggaactggagctggtggaagcgtgcaggaaggcggacatgggatttatcgcgatgaaggcgctgtcaggaggactcatcacaaattccgccgcggcctatgcctatctggcaaagttcgatcatgtgctgcctatctggggaatccagcgggaaaatgaactcgatgaatttctgtcctacatcgggaatccgccagtaatgacagcggaactggaggcggtaatcgaacacgacagaaaggaactgctcggggagttctgccgcggctgcggatactgtatgccgtgtcccgctgagatcgagatcaacacatgcgcccggatgtcgctcctgatccgccggtcgccatccgcgggccatttaacggaggcgtcacagaatatgatgatgaagatcaaggactgcctgcactgcggccaatgcagcagcaaatgtccctatggcctggatacgccgtcccttctggagcggaatctaaaggattatgaggagattctgggcggaaaggcttactagtactgcattgcgtaattaactgtgataaaacacccgctatctacgccagagccgcgcctgcaaagctagtcgtagggtccactacgccgtcgctttgcagacacgcctctgacgcagatatggacacaagaaattcatttgatatttttcctatacggctttataatatgatacgttagcagagaacacgatattatgacaggagagatggattatgaaaaaacgtatcatgctgctcatggttctgacagcggccgtactggccggatgttccggaaaagcgggcgcggcagaccagacaaaatcctccgccgccacagagacatctgcggaggagacaaaaacagacgaaggtacagcagaaggtactgcggagacaaaaacagacgccggtacagcggacggcacaggggaagcagcgaagcatcatgtaaagattcaggtaaaggactacggtaccatttcagtggaactcgacccgacgtacgccccgattaccgtcgagaattttctgtctctggcgaagtccggcttctatgacggactgacgtttcaccgcatcatcgacggctttatgattcagggaggagatccgctgggtacagggctgggcggttctgataccaccatcaagggtgaattttccagcaacggagtggataacccgctttcccatacacgcggagccatttccatggcgcgttcccaggataagaacagcgcaagctcccagttctttatcgtacatcaggacagcccccacctcgacggtgattacgcggtgtttggctacgtgacggacgggatggatatcgttgataagatctgtgaggacacgaaagtgacagacagaaacggaacggtggcaaaggaaaatcagccggtgattgagagcattgaagtggtagactgagatgtaattggcagagtgagactcaagcagcagggaagccttaaattcgattggcttccctgctgctttttcagatgaatactctcttcagagccatttaattgtctggattccatggtttcatgccaaatctgggtacatggcaggcgaaaatccgcaattctactgacagtcggttgctatatttccccaaattttgtacacttcacttgctggatcacgactggaatatggttaaggccggctgcactccgcggatctggcgtacagcattgttcaggcatgttctgataaagcaggaaaagagggaatttatggataatgagaaattcggacagttcgtgcggtccatgcgaaaagagaaacagatgacacagcagcagttagcggaacgcctccatctgacggataaagcggtatccaaatgggagcgggggctgagccttccggatatatcgatgctggagcagctggcgagggagcttgacgtcagcgtggtggaacttctctgtggggagaggaaggaggataatatcaggaaagacgccgtggaagagcttctggtggacactatgagcgattccctgagaaaagagaaaagggtgcgaaggcgctgtttgattcttttgggcaccgtgattgttctggctgttctgactgttttctatggaaggaccgtgatcaactttgcgctggaccggttttcagaaaaatacgagacgtcgtaccataccagcgagttcgagattgtgaggaagagagaccagaaaccggaaagctgttttatttataaagagcctgccggacagttcaggaacaactatcatgtgatggagatcacaagcgacggaagtatccgggagttgtttgtattggaagagacggggatggatttggaccgggcgcctcttcttaaaatggacgacgactgcctttacgtcctgtttgacggcatggacaacgaggaccggacggagcgggtctatcagggggctatcgaggcggatccccagggatttctgccgcggctgttccggtacgattttcagtcggggcaggtgaaggcggtgcctttgcccgatgagaagcactcacttctcatagatgcatttacgtatcaaggagaacctgtggccgtcacgcagaagttcaaggggctgctgttcggcatcaatctgggattttataaaggagaccggctctgtatatcggcaatggacgccgcggatgggcagcaggggacctctgtgcagtgggaccaatactttgaaaatctgacaaaggacggcgggatccggtcagccggatggctggatggggactcctactatctcgcggctccagacggaatcagggagctggatctcaagtcaggaggtacaaaactggtgaaggagatggatctgcggctctgcgggcgtgcggagcttaagaagacggcgctgccggaaggcccggaatgggcggttgtatgttccgtggcggaaacggtgggggagtatggctatccgcaggaatggaagacggttgtcctgggggtggacgagtcttttgaatctatgggccaggtggaactgcctctgtatgcgtctgccgtggaatgggggaaaaccagcgtaatgatatccgacggaggagaggcgtttcagagtatactggtggacttaaagtccatgacgggccaggaggcggtccgcgccggacgcggggaactgaagagcagcctgtatggagcatcctggcagcagaggaatccgtaccggacagatgcgctggaggaaagtaccattcagtgggtctatttggagggcagcggggagtaccgcctgtccgggacggaaaagggaataaaagagaaataaaatattaagtaattcttacatttaaaaaaggggttgtacttttaccctatatggtgttaaggtatagaaagagcagacggcggtagtttttaaccggacggcgctcaattcttaaaaggttttaaggtaaggtgaatgagtatcagaatgaagaaaacaggaatgcttgtaagaagtgccctgctggcggcagtatttatcataatgtcggcgcaggctgtactggcagatgacacgaccagattcgtaccaggaaccagggtaaacggcatcgggatcggcggacttaccgtggatgaagcgaaaacacagatagaaggcttttacagtgcagaatacaagttgacgataaaggagagagacgggaagaccgagactttaaagggcagtgatgtcggatataaagcggcggcaccggaagggctttcggccattctcgacgcacagaatgcctcgggccgtgtgtccgggccttcggcggataattcccacagcgtgaatatgagcgtacagttcgatgagagtgctgtgatgaacgcggtgaacggactttcctgtatcagcgggtcggatattgtagtgacccaggatgcccatattacggcatatcaggagggaaccccctttacgattatcccggaggtgcagggcaataacgtggataaggacaaggcggcggctctcataaaggaagctgtgaaatcaggcagcagtgaagtggatctcgtggcctccggctgttatgtgactgtcggcgtgaccgcggaggatgcggctcttaaggatctctgcgacaccatgaaccggtgcagggacatggttattacgtatcagtttggagagcagacaataaagctcgaaggtgaaactatctgtacctggattctcggaagcacccaggatgggcttgtggatgtgaattacgacaaggccgcggcgtttgtaaaatccatggcagatcagtatgatacggccggaaagacgcgggcgttccatacgacaacgggaaaagatttgaatctgaccggtccctatggatggcagattgaccaggcgggcgagacggcatcgctgatcgctatgatccggaccggacagagccagctgagggaaccgttatacagcaagaaggctcaggaccggaccacggactggggaaagacgtatgtggagattgatttgacgaaccagcatgtctacatgtatcaggatgggaatctggcctgggatgcgccctgtgtgacggggaatgtatccaagaattacacgactccggaggggatctacagtctgacctataagcagacggacagagtgctccgaggcgagaagaaggcagatggcacatacgagtatgagagccatgtggattactggatgccgtttaacggaggcatcggactccatgacgccagctggcgaagtaaattcggcggcaccatttaccagtacggcggaagtcatggctgtatcaacctgccttcgggaaaggctaagactctttacgatatggtttacaccggcataccggttatctgttataattagtttgagttgaatattttttagaatattaaagagtccgggcctgccggacacgctgacggtcggcgtgtctggcaggcccggactctttattctgcctcgcggcattccgccgaacgcaggtaaaaggatctcaaaaaatgaactgtcttgtcagctgccgttttgattgacaagacagatggattatggtaaatttaaacaaaagggcagtactgtttttggcgaaagtgtcagagagataaaggaagtacagccctttctgaacgtgataacagataacagaaaacagaaatgagaaataagaagggagatgggaacatggatgagatcatgcctcatatcaggctgtcaagggaacaggccgcggactatgtgcttctgcccggggatccgcagaggctgaaccggattgcggagtgccttgaagaggtggaagaactggcttataacagggaataccggagcctgagaggcgtctacaagggcgtttcggtcatggcggtatccacggggatcggcggagcgtccaccaccatagcggtggaggagctggcgagaatcggtgcgaaagcgatgatccggatcggaagctgcggcgctttaaacaaggggatccggctgggggacttaattcttgtaaacggcgccgtgcgggatgacggtgcctcggtcacgtatgtggacagtatttacccggccataccggacacggaactgttagtggcatgtatggagagcgcagaggagctgggggcgaaaacccatgtgggaatcgccaggagccatgacagcttctatatcgacgacgaggaggcggtcagcacctactggggagagaggggcgtgctcggctccgatatggagacagcggcgctgtttgtcgtcggaaggctgcggggcgtgaggacggcctcgatcttaaacacggtcgtggagtgggaggattctctggaggagaacattaacagctatacaggcggagagtccgccatgatgcagggggaacggatggagattcttacagcgcttgaagcgtttgtacgaatagataaaaacaaacagggaggcaattcgtatgagtaatatttttaaaaccaaattgaatgcagcatgtatcgttctgattccggcctgtatcggaatcaactatttagggaagctgttcgcgtcagtcctgaagctgccgttatggctggattccatcggaacctgtatcggcgcggtgctgggcggtccgatcatcggaggaatctgcggcgcggcgaacaacttaatctacggctttaccacaggcgattccatcaccctggtctatgcgctgaccagcctcggtatcggcgtagcagtcggaatcatggcaaggctcggacgcatgaagaagctttccggcgctgttttaacggcatgcgtagccggatttgtggcagttctcatctccacaccgctcaacatcctgttctggggcggtactaccggcaacctctggggcgacgcggtattcgcatggtctcaggcttccggccttccggtcgcgctgggctccttcctggacgaagtgatcgtcgatgtcccggataagctgatcacactgttaattgtgtttgccatcatcaagggactgccgaagaagctgacctccctctatgagatgggcgatgaggtggaaagcctcgattaatcatgaaattttaaatgaaggatggagcgttttatgaaaagtatcagcctttttgtggacaaagatacgtatttgaccaggctgcatccctttgccaagatgctttacatcgtggcggccatcagtgtgcccttaatcacgggcacactgtggatgttcggcgtgtttatcgcagtcagcctgggactgctcatcagcggaaaaatcattaaaaaggtctttccgctgatcgctttttcgtttaccatcatcatcacggtctttctgatccacggtctgttcaaccgggagaatcagaatgtcctggcggccttagggccgcttaagttctataaggaagggcttctctacgcttccaggatcgggcttaacatcttaaacatgcttctggcgttcgccatgtttgtgctgactacgaagccggccaccctggtggatgatttagagcaggcgggcttttccccgcgtttcggatatatgatcagttccgtgtttcagattattccgcagatgatgggaacgatgaataccatcatggatgcacagcggagcagagggatggagacggaaggaagcctgttcgtgagggcgaaggcatttatcccgctgatctctccggtggtaagcagctccctcatcaataccagggagagggccatcgcgctggaggtgcggggctttgattcgaagacaaagaagacgtttttaagcgatcacaagatcaaggggcgcgacagggcatttatggttctgatggtcctcctgattgcaggttctatcgtatggagggtgataagatggctctgattgaagtgacaaatttgaaataccgttacccccatacggaaaagctggcgctggacggccttaattttttagtggaaaagggcagctttatcggcattgtaggtgaaaacaaggctggaaagagcacgctctgtcaggctctcgtcggcctggtgcccacgatgtttaagggggcttatggcggaaagatcgtgatcgacgggcaggaagcggccaaaacaccggtggcgctgctctgtcagaaggtgggactgatctttcagaatccatttaaccagctttccggggcgaaggatacggtatttggagaaattgcttttggcctgcagaatttaggcgtgccgcgggaggagatcgtgcgccgggtggaagagaatttaaggctgctcgacatcgaacagtaccgcgacaggaaccccttcgatttatcgggaggacagacgcagagagtcgctatcgccagtattctggccatgcagccggagattatcgtgctcgacgaaccgacctcccagctggaccctcagggaagtgaggaggtgttccgggtggtggataagctgtccaaaaccggaattaccatcattatggtggagcataagatggaaaaactggcctcctactgcgataaaatcctgcttctccacgatgggaaacagattgcgtacgatacgccggagaagatattctccagagatgatttagaagaactgggcgtggaagcgcctgtgtttacaagagtctgccggaagctttccgtgtgcagaaaagaggagggaaagcgcctctatccggtgacgatggagcagaccatggccttgcgggatcagtttccggcggggttaagcggaaagagagtgggggcagaagggctgccagctgccgccgacagaatgtccggggaaatcttccgtataaaggacctgtcgttccactatctggagcatgtgcctgttttggaaggccttgccatggagctggatgcgagacccactgcggtgatcggccagaacggtgccggcaagacgacgctggtcaagctgttaaaggggcttttgaagccggtttccgggtcaatcctgtttggtaatgaggatatctcggagcggacggtggcgcagctggccggcagtgtggggtatgtatttcagaatccggatgaccagatttttaaaaaccgtgtgatggacgaagtcatggtgggcccccttaatatcggcatgagccgggaggcggcggaaaagcgggccagagaagccctttccatggtaggactcttagatgcggcggaagaaaatccctatgatctggatttatcggagaggaaaatggtggcaatcgcgtctgttgtggccatggatacaaaggttctgattctggatgagccgaccattgcccaggatgcaagaggacgcgcagtcataggatcgattgtaagaaaactgagtgattccggaaagtttgtgctggcgattctccatgatatggatttcgtggcggagtattttgagcgggtcatcgtgatggcacacggaaaggtgctggccgatggaccgaaggagtccgtattttatgaggtagacgccctggcggctgcaaagctggaacagccccacatggcggccctctgccggaaactggggtatgagggggcatttatgacagtgaatgatataaacgacagaaaagatgggactgcggaacaggagtgatggatcgagtggatggagataagagaagacagcagatcatggagatactgaatcaggagacgtctcccgtgtccggagcggagctggcgaagcgggcgggagtgagccgtcagatcgtggttcaggatatcgcccttctgcgggccgagaataaggagatcatgtccacaaataagggctatgttctctataaaccccagcagggggcagagaaggcgcgtgtccgtgtcttccgggtgaatcacgatacggagcacatgctggacgagcttcagacgatcgtggattacggaggaagaattctggacgtatctattgaacacgcactctacggccagatcagtgtggatttaattatcaacaaccggctggatgcgctggaattcgtgaatcagatggcgatgagcagggatcagccgttaaaggccctgaccggcggctgccattaccacacggtggccgcggattcggaaaagaatctggatatgatagagatggagctccaaagaaagggatatctggtctagaccggatatccctttttgacggccggcggcagccttcaggctattcgctgcagaatacaatgatcttttccggcgtggtcatggccgggatgctgcgcgtggtggtactgtagagtaccagcaggtagtgattcgccggtgtgccgtagtagatctgtccgttggccataagtacttcggtcccgcctctttccgacaggtttaatttgagcgtcgcatctgaattaaccagattttcgtcaaaatagtcgaaggcggcaaagagaccgtcatccgtctctgcaatcaggactgcgtgatagcggggcggataaatgagtggggtggggaccgaactgtcatagaatgcgacaatggggtctcctggctttaacgtctcctggccttccacataggtgaggggggtgacagtaaaggtaacagggccgatatcctgcgtcatgacgaaaaataaaagggtgcagtcctgcgtgccgtctgctgtctgcatgggggtgatggaggtgatggttccataaaccggtgtaaactgtgccatgtgatattccttatgcatacactttctatttatcatatgaaaggggacggcgatgcgtgaaacggaataaatatgaaaaattttaaggttacaaaaatatttagaaaatagctaaaaatagcgaaatgtgactaaaattttgtcagatatcgagtaaattacaatggacaggttgtgataggtttagtataatggaagtgtcgcgtaaatattttcagtctttttgtgagatgcgtgacagctgtatacggaggagaggagaatcagacatggaaaacagcaggtttgcagtgatcagtgacagctcctgtgatttacccgatgagctgactgcagcgaaggagatcacggtggtgccgttctatgtttcttttgacggagaaacctataaaaaagagggcacggaaatcggcatccgcgaattttaccgggagatggtggagcagcccggtgtatatcccaaatcttccatgccgtcgatccaggattatgtcgacgtatttcagccgtttgcgcaggcgcacattcctgttctgtgtatctgcatcacgacgaaattcagcggttccatgcagtccgcgctgaatgcgaaggagatggtgctgagccaatatgaggatgcgcagattgaagtgatagacgcaaccgtgaacaccgtacttcagggactttttgtgctggaggccgtctcgatgagagaggaagggatgaccctttcggaggccgtggcggcactcgacgagatcaaggagagcggccggattttctttacgatcggaagcatggattatctgcagcacggcggaagaatcgggaaagtggccggagccgcggcttctgtgctggggatcaggcccatcattaccctgaagcagggagagatatttccaagcggaatatcgaggagcaggagaaaatcgatcgataaggtgatcgctcttttgctcgattatttgaaggaaaacgggcggcccatgagcagctaccggtttaccataggctttggctatgatcgtgaagaggcggttttatttaaggaacaggtgcttgcagcgctcagaaccggggggtatgagatggaagatgcctggatcaaccagattggtgcgacgattgccgttcacacggggccgtatccgctgggaatcggaattatcagacgtcataaaaaagaaaggcagggagaatgagttatcttgcagcaggcgtgattgcttttggtatgtttttactctatgatctgaacagctttacctggaaaaaccgcattctgcacacctttttcctgatcgggaacgtgattctgctggcgtctacggccgcctgtttcgtcacactgatccgggcgtacggagcgccggtctggagaattgtgatttttggtgcgctggccgtgagccaggcagcactgctgatctacacactgttttttgcattgccgtttgagaaaacgtataccaggctggaagaaaacccgccagtgtacacagagggcgtttattccctctgcagacacccgggggtggtgtggtttttctttctgtatctctttctcgcccttttaaccgggcagagactgatgatggctgtgtgtatctgttacagtgggctcaatgttttgtatgtctggtttcaggaccgggttacatttaaaaggacgctttcaggctatgaggcgtatcagagggaaacaccatttctgatacccactggaaagagtgtccgcaaatgtgccgggtacttccggacaatggaggaggacggggatgaaatttgaagaaaaactgaaggagcgtaaggattgggagctctggaaggaatactgcggttttctggatttaaccatagatgagtttatggcgattcagaaccggcttatgctggaacagattcgtaaatggagggccagcgggatcggtcagacgattttgaagggcaggaatccggagacgatcgaagagtttcggaaaatggtgccattaacctcttatgaagactatgcggacagtctgtccttaaaggacaaatccatacttccggatgatcctgtggtctggattcagacgacgtgggagggcggaaggcatacgatcaagctggctccctatacccggagcatgctggagacgtaccagaataacatgcttggctgtctgatgctgtccaccagcagcgggcggggagacttcgatgtcaatccgaaggataccattctctacgcgcttgcaccacttccctatgcgacgggaatcttccctctgcttctcaacgatgcgatcagcatcgaatttcttccaccggtcaaggaagcccagaagatgtcattcagtgaacggaataaaaagggctttaaaatgggcttaaagaaagggattgacttcttttttggcgttggaagcgtcacgtattacgtcagtctcagcatcgcgtctctcggttccggacataaaagcggaagcggttcgggaggcggagacggcaaaaagaagatttccatcagtccggctatggtggtccggctgcttaaggcaaagcatctatgcagaaaagaggggagagacttacttccaaaggatttgttccgtctgaagggctttatgtgcgccggaacggacaaccgcctctaccgtgacgatttggagaagctgtggggcgtgcgccccatggagatatttgccggaacggagccgacgtgtatcggaacggagatctggagccgggacggtatgtacttcttcccggatgcctgcttttatgagttcatcccggaaaaggagatggagcggagtctggcggatccctcctatgaaccgcgcacctgtctcatgaatgaggtggaggagggcgagaagtacgaacttgtgatctcggtgctgaagggcggcgtcttcatgcgttaccgtgtgggggatgtctatcgatgcatcgccctggaaaatgagcgggatcaggttcgattccccagattcgaatacatagaccggattccaacggtgatcgatattgccggatttacaagaattacggagaattccatcggccgggtcatcggattgtcaggactgaaggtgaaggactgggcggcggccaaggagattacggagaataagcggccatttctgcacatgtatgtggagatggagccggagtgcctgttttcatctgccgtaaccgtcaacatattaaaggagcacatgggggtctatttcaaatacgtcgacgaggactataaggacttgaagaagatactcggaattgaccctctggagatcacgatcctgcggtgcggtacgtttgacacgtattaccgcgggggcaaggagaagatgcggcggatcaaccccacccagtatgagatcggagagcttttaaagagtcaggaactggtttccgcttttggaaggaggcctgagagaagtgtataactactcatttatctctgtgacggctctgttttgctacatgatcttatttgtggcgttcatggccgcgcagaagacgaaaatcatccactcatttctggtagtgctggccgcgtttttactgtggacaggcggttccctcgccatgcgtatggagctgtggccggaagtggaattctggttccatttttccatagtgggcctgattattctgccctttacgttttttaactttatctatgcgctggtggattcggatgacactatcctgtggtggtcgtggctcatactggcagtgatcaataatgtagccaacatcaaatggggcttctatattccatgcccggaagtgataaggctggctaacggatcagccggattcgtgtaccatatcggctggccgattattatcctgtttatcaccatgtcgtttccgatcatccatatgttttacctggtgcataagtcgtacaggaagaacacggtggaacgaaatcagctgaagccgatctttgcaggaatcgtcattctgtttatcggccatgccggaactctggtgccggtgttccgcggattcccgacagatgtcctttcaggcatcattaacgcgggattcatgttctatgcattatataaaaagcatttattccggctgacactcctggtttccaggggagtggtttacggaatcagcacgttgctggtggcactgctgtttgccaattacatcaatccgctccaggagtttattcagaggaacatgccggtatttgcgggaagcagccttctgatcgtggcggtgtgcttcgcgctggttacgttcttactgtcatcggtggtgaagacatttatcgatattctgtttaccaagggggaactggtccagacggagaatttaaagaaattcagcacagcagtgtctaagagccttgaggtggctgatatcgtggaggagatctcgacggttatccaggagacgctggcggtagagaccatctatatctgtctggccgaccaggcgggagagaattatgagacggcgcaccggtcccgtcccatcagcggcgtaaacattaccatacggggggacaacccgatggtggagtggatgcgccagaacaggcggtgtatccagatatcggaattccgcaggaccgtgctttttaagtccatgtgggaggaggagaagcagctgatccgggaactgggaatccagtgcatgcttccgctgcaggacgaggaaagcctggctggaatcgtgcttctggcctcgaaaaagaaggggaaatcctacggctacgatgatttgaatttcctggaatcagtcagttccatcgcgtctatcgcggtccgcaactccaggctgtatgagaaggcctgcatggaggcccggacggatgagctgaccggacttttaaacaggaagtatttctatgagcttttgaatcagcagtatgagaagaagccgaacaaggagctggccctgatcatcatcaacatcgatgattttaagctgtataaccagctctacggcatgaaggagggggacgctgcccttcagaatgcggcgaagattatcagcgccacggtgggagagcgcggttatgtggcccgctacagcggaaaggaattcgcggcggcgctgcctgatttcgatgtgctggcggccaggaatatcgcggaatccatacggatgcagattttaaatatgaacaagagggccacggattacgccttaaaggtgctgaccgtgagctgcgggatctgtaccatcccatattcagccagcaatatcaagcagctggtggagaacgcggacatggctgtattttccgtgaagcggaaggggaaaaacggcgtcatggtctatgacatcggatcccatatagacggaaatgcaaagggcggtgaaccgctggtgagagaggatgtctatacctcgtaccagtccaccatctatgcgctgaccgcggccatcgacgccaaggaccactataccttcagccattccaggcatgtggcggagtacgcggggattctggcggaagagtacggcatgagtgaagacttcatcgagctggtgagggaggccgggcttctccatgatattggaaagatcgggatcccggaacatattttaaacaagccaggaaggctggagccggaggagtatgagaccatgaagggccatgtggaagcggccatcggcatcatccggaacctgccgtctctggactatgtaataccggccgttatcggccaccatgagcggtatgacggcaagggctacccaaggggaatcgcgggagaagatataccgctctccgcaagaattctctgcattgcggattcctttgacgctatgatatcaaaaaggtcctacaaggaccgctgctccctggaatttgccatggaggagatcttgaaacaggccggtaggcagtttgatccgcagctggcgccgctgttcgtggaggcggtccggaaggggaaaatcaaacccgaagaggagtgaaggtggcttcgcgcacagaaaggttcttccccgcctccaggtgcgtcccggcacagggggagttgatatcccgtgtccgccttgcttcctactcgccataaaaatgaacgtgactgacggacacataatgcgtgtgttcgccagtcacgttcatttttatgactagtgtctcccggcgtaaatatgtcgggaggcactggtatccagatggcggcacactgggatatcaactccccctgtgccgggacgcacttggaggcggggaagaacctttctgtgcgcgaagctttgaatttagaaaaagcgaaaaacaaaaaagtaaaagttagaagcgggggattgaaaataaaatttgtttttatatgagagtggatcgtaataaaaatgtcataaaatcttatcagaaaagggttggacatcatgcatggccatgcgttataataaacacattaactaattgctagtaaagaggtaggaattaaatggaaagagaaaaaccacgcagcagaaagaaaaagcggctgggcgtaaagttctgggcagctgtctgcggcggtatcgcagtggcggcggctgccacggttaccgtgttgtacatacagacgggaaagcagtatcgtactgtgtttttcccaaatacgactattaacggcattgatgcgtcgaagaagactgtggatgaagtgaagcagctgatcgcttcgggcatcaacggatatacgttgaccatcaaggagcggggcggcgcagaggaagtgatatcgggcgatgagatcggcctggaatcggtgtttgacggcagccttgagaggcttctggaggaacaggagcccaacgactggttccgccatcggaaggcgactcagacttttgagatcgatactatgatccagtttagtgatgagaagcttacgggcgtggtggatgcgctgaactgctttgatgagacgcaggtggtgaaaccacaggatgcggtgatgtcagagtatgtgtcaggccagggatatagtgtgattcctgcagtagagggaagcgaactggatagagagaaggtgatggccggtatcgcggaggcggtaaacggcttacagagagagctatccctggaggaactggaggcctacgtgaagccgggagttcccagtgacgacgcagagctcctcacccgcgtgcaggcgcttaataaatttgtgaatgtcagagtgacatatacctttggagacagtcgggaggtgctgagcggcgatactatcaaggactggatcggcatcggtgacgatggaaacgcttatgtcagcagcggagcggtcacggagtatgtgaagagtctggcctccaaatacgatacctataataaggcaaaaactcttaatacctcctacggaaagaccgttaggattacgggtggaagctatggctggagaatcgaccagtccgcggaggcggatgaactggcagctataatccgttcaggcgagagtcagacgagagaaccggtctacaagcagaaggcggtcagccatggggccaatgattatggcagcacctatgtggagatcaacttgacggcgcagcaccttttctattataaggacggcagtcttgtggtggaatctgactttgtgtcgggtaatgaagccaagggctgggcgactccggcgggagtttatcccctgacctataagcagaaggacgcggttttaaagggcgaagattataagaccccggtggattactggatgccgtttaacggcgggatcggtctccatgatgcgacatggcgttccagctttggaggcacgctgtataagaacggcggatctcacggctgcgtcaacctgccgcattccgtagcacagaagatatttgagaacatctcggcgggtactccggtactctgttaccatctggagggaaccgagtcaaagaccacctcaacaccggcgggcaagccaatacagccgacgaccgcggcaccggagacaacggcggccaccactccggcggctactaccccggcagctacgacggcgtctcccgagaccacggccccgtctgaagctcctgcgcccaagccaacagagagccagactgcggcccctacaaaggccccggagacggaagcctcgactacggcggcttcaccggagagcagagagaagggacctggagtaccaactgggagttcagggaataaagagattggaccgggcgtctcatgacgcctggcggaagatacgacaaagggatttatgctgtgaaaactgtcagagcatgaagaatggaccgtagcacgaatgttacttgattattcgtgcggcggtccattttttggataatccggcatttgtatctggggtcatgatttgcgggtaaaagcaggtcatgatgcagatatggcaggtaatcacaaggattgcctgccatttaaaaaatcggtatctttttgtattattcccactcaatcgtagccgtaggcttcggactcagatcatagcacacacggtttacattcttcacttcttttaagatcctgtctgtaatctttaacagcacggcgtagtcgatctgttcaatcgatgcgctcatggcgtcgatggtgttgacggcgcggaggatgaccggataatcgaagcatctggcgttgtcgcggacgccgacggatttgaaatcaggaacgacggtgaaatactgccatacggtcttgtccagtccggcattggcaaattcttcgcgcaggatggcgtcggattcgcggactgcttccagacgttcttttgtgatggctccgagacagcgcacgcccagaccaggacccgggaacggctggcggtataccatctctgctggaagtcccagttctacgccgcaggcgcggacctcatccttgaacagctgacgcagcggttctaccagctggaactgtaaatcttccgggagaccgcctacgttgtgatgggatttgaccatcttcgccgtcttggttccgctctccacgatatcgggatagatcgttccctgtgccaggaattcgattccctccagttttctggcttcttcctcgaaaacgcggataaattccgcaccgataatctttcttttctgctccggatcggcaacaccggccagcttgccaaggaaacgatcgacagcgtccacgtagactaaattagcgtcaagctgatgcttgaatacgtcgataacggactcagactcgcccttgcgcatcaggccgtgattgacatggacgcaggtgagctgtttgccgatggccttgattaaaagggcggctacaacggagctgtccacaccgccggagagtgcaagaagaaccttcttatcgcctacctggctgcggatcagttctacctggtcggcaatgaaattcgtcatgttccagttggcctgcgcatggcaggtgtcaaatacaaattctcttaccagtgatactcttgtctcttcgtcctctggccattcggttacgctgttctcacaggctgccggttcgtggccggcggccatgactggataacccgcctcgtagatctccggcagtacgtcgatccgtacgccgtccacgatatggttaggtcctccgtttatgatcacgcccttgacattgggaagttttttgagctcttccgcggtaatgtcatggggataaatttcgctgtagacgccgaccgcacggatttcccgcgccagccttgtattatctgtacttcccaaatccagaatgactatcatatcctgtttcataagtgcctcctttaaccttctctgatgtattccttttcataacataacttgtaatgctgtgattgtaattctgtaattgcaaccctgtaatatagtgtagcagaaaatgaatcgaaggtaaatgaatttttcatgattttggcagactttcagtagacaaatgcagaaattagccgtatagtatatgatgaattgttgcgattgcaacagttgaaactgcaagtgaagagatggaggcagacatgtttcgaagattctacggttacatgaaggattaccggaaatacgggcttttcagctgtgcctgtgtggcgctggaggtcatgttcgaactggtgattccgctcgttatggcggatatcatcgatgtcggcgtggcaaacggagacagaaggtatattattacaaagggaatcgagatgtgcatactggcgcttatggcgctggggcttggcgccgcgtattccagatttgcggcgctgtgtggccaggggctgggagcggagcttcggaaggcggaatatcagaagatccagagcttctctttttccaatacagatcatttcaccacatcgtctctcgttacgaggcttaccagcgatgtgacggtaattcagaacgcggtaactaccggcctccggcccattgtgcgtgcacctgtgatgatggtgacggctctctgcctgtcattttccatcaatgccaggctggcgctgatcttcctggtggcggctccgcttctggggattatcctgtttctcatcatcagccatgtgaggcctctgtactcccggctgcagaagagcatcgacctggtcaaccggatcgtgcaggagaatttaacggcggtccgcgtggtcaaggcctatgtcagggaaggccacgagatggagaaattcgacgcggtcaactcggaactgcagaccgtatcggagagggcctttggcctggcatgtatgaacatgcccgccatgcagtacgtgatgtatgcgaccatcgtgtccattctgtggtttggcggcaacctgatttttatcggaggaatgcaggtgggggaactcaccggattcttaagctatgtgcttcaggtcctcaattccctgatgatgatctccaatgtcttcatgatggtgacccggtccatggcctccggaaaacgtattctggaagtcctggatgaagaaattgagattcaggacgaaagcagagaatcacttactgtggaagaaggcggaattaccttcgatcacgtgtcatttaaatataagaagaatgcgaaggagtacgtcctgtccgatgtcagtctcgacatcaaaccggggcagaccgtggggattatcggcggcaccggttcggccaagacgacgctggtccagctgattccgaggctttatgaagccacggagggggaagtactcatcgatggaaagccggtgaaagcgtatccgctggagcatctgcgggacgcggtagccgtggtattgcagaaaaataccctgtttaccgggacgattgaagataatctgcgatggggaaaagaggatgccacgaaagaggaaattgcgtgggcgtgtgatatcgccggggcggccgagttcgtggaacgtttcccggagggttacgatacgtatctcgatcagggcggcgtgaacttatcgggaggccagaagcagcgtctctgtatcgcaagggctgtcttaaagcggccgaagatcctgattctcgacgattctaccagcgccgtggacacggctactgaggcgggaatccggagcggtcttaaggagagccttcctgacatgacgaagatcatcatagctcagcggatcacctccgtctcgggagcagatcagatcattatcatggacgacggaaaggtacacgcatcaggcagtcacgaggagctgctggcgaaagatcccatttaccaggaaatctattattctcagcaggaaggggtgggcttataatggcgaaatacatcggttacaagaaaccgaggaacacgaaaaggacgctgctgcggctcatttcctatatgggaagacacaaattttccatgtttgtcgtgggaatcctggtgattgtcagcagtcttgccagcgtattcggtacgtatatgctgaagccgattatcaaccagtacatcatcccgaaggatattccgggactcgtgaaggcactgctcttcatggggatcctgtatgcggtgggagcatcggccacgctggggtataaccggctgatggtgaaaacgtcacagaagatcgtaaaggagatacgaaaggatcttttcaatcacacgcagacgctgccgctggcgtattttgacgcccatactcatggagagctgatgagccattttaccaacgatgtggatacgattgccgaggcactgaacaacagcttcacactgctgatccagagctttatcacgacggtcggcaccatggtgatgatcgtgatcttaagcttccgtctgtcgcttatcgtgctgggctgtatggcgctcatgttcctgtttatccggttcaatgggaaacggagccggaaatatttcatggaacagcagaagtatttgggcgagatcaacggatttatcgaggagatggtggcaggacagaaggtggagaaggtcttcaaccatgagaagaaggattttgaagaattctgcaggagaaatgagcggcttcgtcaggcgtccaccaatgcgatggcgtattccggcctgatggtgccggtagtcgtcagtatttcctatttaaactatgctgtgtcggcctgcgtgggcggtttattcgcactggcaggactcatggacatcggaagcctggcttcctacctggtctatgtccggcagagcgccatgccgatcaatcaatgcacccagcaggtgaatttcatcctggccgcattgtccggcgcggagcgcatctttgaaatgatggacgaagagccggaggtggatgagggaaccgtgacgctgtgccgtgtggaggagaagccggatggcagcctctgcgaatgcagccggaagagcggcctctgggcctggaagatgccggacgaagaaggaagagacaatacccttatccccttgacaggcgacgttcgttttgagcatgtggtgttcggctacaattataagaaaaagattcttgatgacatcagcctctttgccaagccggggcagaagatcgcatttgtgggttccacgggagccgggaagacgaccattatcaatctgatcaaccggttttatgagatttcaggcggcgtgatcacctatgacggaatcgatatcacaaagatccggaaggcggacctgcgccgctccctgggatttgtcctccaggatacccacttatttactgggaccatcgaggagaatatccgctacggaaacctggaagctgcagaggaggacgtgatcaatgcagcgaagatcgccaatgcgcattcctttatccggcgtctgcccgaggggtatcagacggttctggaaagcgacggcgcgaatctgtcccagggtcagaggcagcttctggctatcgcccgggcagcggtggcttctccgcctgtgctggtactggatgaggcgaccagctccatcgacacgaggacggagcacctgattgagaagggcatggacgcgctgatggaagacagaacggtgttcgtcatcgcgcaccgcctttccacggtgcgtaattccaaggccatcatggtcctggagcacgggaagatcatggagcgcggaagccacgaggagctgttggaacagggcggacggtattaccggctctatacgggccagtttgaactggaatgaggggcctgccgggatccggcagtgctccgggcagtaactgctttacatggattttacaaaaaaatatggataaaatcttgaaatccggcgagaaaaaaggcataataagtggcgttggattgtgatcgataagaaaggcggtaacagagaaaatggaccgaaagcaggaggtcagggacttaatgttccgtaccgagatggccaggaagaggcggatccatccggtatggaccgatatggggctgatcgcgggacagcccagggtgttaagccagctgttcatcaaagataaaatcacacagaaagagcttgcagaggcgtgctgtatcgagccggccacgctgtcacgtgcgctggaccgtctggaagccatgggatatattatcagaaacgacaatccgcagtgccgtcgttccttcttaatttccctgacagaggctgggaagaagatggcggtaaaggtaaaagagaccttcgagggactggaggaagagatgatggaaggcatttccgatgaagagatggatacgatcatctccctggtctccagaatttacgataatctgcgaaatgaagaagaaagcgggggcatttaacgtatgggagcattaaaaaaggaaacatttgtgccgatggccttcttcaaaaaagaggcctacacaggcagctttaagggaatgcgttaccgcgtagtaaaagccgaagaccagttcgaggcagtcgtctacccggaaccctactgtttcgaagcaaccccggacgagaacaaggtaaagaacaccttcccctttaccgaagaaggcagagaatccgtcgtaaactggttaaacgaccaatacgactcccgcaaatcagaatgggacgctgccgcccgctattgattagaggcagtagaacacgctgcagcctttctcccatataaagccagtacacagccccagtgattgcggagagggcgaggaggccggggaggaggagtgtacagcttccttttccgaggttcgcaggaacttaagcgggaaggcaggaaaaatgggtggcgaaagttggcctccaagccgactttcgagggcacacggaggaaaaatccttcaggatttcttccgtagtttgcccgatccgcccatttttcctgtcttcccgctttagttcctgccaccgaggaaacaagaagctgtacgctcctcctccccggcctcctcgccctctccgcaatcactggggcgtacccccacaaaattatcattccccctttcctatttctcccaaatatgatatgataccatattattgggactatttatatggaggaaacaagatggaagaaaacagagaagtattagaaactgcggaaaaagaagaggttgtttctaaaaactttatcgagcaggagatagataaggatctggcagagggcgtttataatcacgttcagaccagattcccaccggaacctaatggatatctgcatatcggacatgcaaagtccattcttttaaacgatggactggctaagaagtatggcggaaagtttaaccttcgttttgatgatacgaatccgacgaaagagaagacggaattcgtggagtccattatagaggatgtgaagtggctgggcgctgattttgaggacaggctgttttttgcttccaattacttcgagcagatgtatgagtgcgcggtcttcttaatcaagaagggcaaagcatttgtctgtgatttaaccgcggaggagattcgcgaataccggggcgattttaagacaccgggtaaggaaagcccttaccggaaccggagcattgaagagaacttaaagctctttgaggagatgaaggaaggaaagtatcaggacggagagaaggtgctccgcgccaagatcgatatggcttccccgaatatcaacatgcgtgatccggttatctaccgggtggcccgtatgagccatcacaacacaggcgataagtggtgcatctatccgatgtatgattttgcccatccgatcgaggatgcggtggagcacatcacacattcgatctgtacgctggaatttgaggatcacagaccgctgtatgactgggtagtgagagaatgtgaatttgagaacccaccccgccagattgagtttgccaagctgtacttgacgaacgtggttaccggcaagcgctatatcaagaagctggtggaagacaggatagtggacggctgggatgacccgcgtctcgtatccatcgccgctctgagaagaagaggctatacaccggaagccatccgcatgtttgtggatctggtaggtgtgtccaaggcgaacagctccgtggattacgccatgctggaatactgtatccgcgaggacttaaagctgaagaagccgagaatgatggctattttagatccggtgaagctggtaatcgataactatccggatgacacgatagaatatctggatgctcctaacaatttagagaatccggagctgggagagagaaaactgccttttggaaaagaactctacatcgagcgggaagatttcatggaagagccggttaagaagtatttccgtctgttcccgggcaacgaggtccgtctgatgaacgcctatttcgtgacctgtaccggatgcgagaaggatgagaacggtaatgtaaccgtggttcactgtacgtacgacccggagacgaagagcggttccggattcacagccagaaaggtaaagggaaccattcactgggtagccgccaggactgccgttacagtagagtgccgtctctatgagaacatcgtggatgaggaaaagggcaagttaaatgaggacggaagcctgaacctgaatccgaattctcttaccattataaagaactgctatgtggaaccggcgctggccgaggcgaagccgtacgacagctaccagtttgtgagaaatggctttttctgtgccgactgcaaggacagcactccggagcatctggtatttaaccggatcgtgtccttaaagagttcctttaagattgcgaaataaaggtttcgctgtttgataccattttgataaacaggcaattagaaatgccgcgggggatataatgtttgacctggccggaccgatctgcggtgacgggctggaagaacctgatcccgcggcactttttatacctgcgatatgctttaccagtacgctggcgtgtgtttggccattgggtccgcacaccagtcttaaggaggcggagacgtggaactgatgatccctctggacagccattcagagatgccttattatgaacagatatacgaatatatcagagaagagattaaaaaggggaatttaaagtcctccgcccgtattccctcgacccgccttctggcggagcatttaaaggtcagcaggagcacgacgcagatggcctatgagcagctgctgtcagaaggatatatcgaatcggtaccgtgcaaaggatactttgtgtcgcgtatcgaggagctggtggttacggggcaggagaacgggggagaaaacctgtttttcggcatgtatccgtgggaagtaccgggggacagtcacccggcggccggagaggcggaatacaaggtggatttctcaccgcgcggcgtcgatctggacagttttccctttaatacatggagaaagatcacgaagactacgctggtggacgacaacaaggagatgtttgcgaccggagatccccagggggagccggcatttcgtgaggcgatccggggctatctccattcggccagaggcgtgaactgcactgcggaacagatcgtcgtcggtgcaggaacggaatacttattgatgctgctttcccgtattctggggccggatcataccatagccatggaaaatcccacatacaagcaggcgtaccgcgtctttaagagcctgggatatccggtagtgcccgtggagatggatggctccggtctggagacttccctgctcgagagaagcggggcagatatcgcctatgtgatgccgtctcaccagtatccgaccggaatcgtgatgccggtaaaacggcggcaggagctgctctcctgggcctgcaaaaaagagggacgttatctgattgaggatgattacgacagtgagttccgctataagggaaaaccgattccggccctgcagggaatggatggaagggaacgggttatttacagcggaacattttcaaagtccgtagcgccggctatccgtgtcagctatcttgtgctgccgaaaccgctgctggcggtctaccgggagcgggtgaatttttatacatccacggtttcgagaatcgaccagaatatcctgtaccagtttatgatgggcggctattatgagcgccatttaaaccggatgcgggccgtgtacaaggcgaagcacgatacgctgattggggcgctgaagccatttgaaaaacaatttacgataaaaggagagtatgcaggcctccatctgcttctgacggataagaaaaaccggacggaggagtggctggtagagtctgcgaaacaggcgggggtaaaggtttacggcctgtcttcctatctgatcagggaggggaaggccgtggtggtgcctactgtaatcctggggtatgcgatgctcagtgaagatgcgattaaagagggaatccggctgcttaagacagcctggtcatcagatggagaacaggaggagtaatatatgaagaataatagggactttccgctcaggaccgccggagttgccgccgtaattgcggtgttgctgcttgttttaagcattcttggaaatgtccggatatccggttacttaaaggccagcatggaggaatccatccatcatgtcgaaagtgagattgccagcaaagaggtacaggaatccatcgaggaatcgaagatggaagagactgcggttcacgagatttcgctcacttatacagaggagcagcttttaaatctgctggaggggaagatgcacgccaatgatttggagggcgctgcgagagtactgaacgagaatgatacggcatttcaggatttattttttggaaagctggcggatgagacgtgtctgtattcctcgccggtcgacgctcagggggctgatccgcataccggcggcgtgatgaaggacgaggcggatggccacggcctcgtgtttcagcgtgcgggaaccatcttctacggcgattttaaggacggtaagccgtctggccagtgtgtggcccttcaggcgattacgctggatgagggagtccgctacgattattccgtcggtacgtggacggatggcgtcatggacggcgccggagagtgcggatacgattactatgaaggcgtgaccggagacggggcgaaaaaaacggtgaagaaaggaaactttgcagacgacctgatggagggagagatctcctataccagcgtcaacggggatggggaatcgacttcgtggaccatgacagtggaaaatggggtgattgttccggacgcaaggtggatttccgatacatccgatgatggaacgcctgtctttcggctgatggccgatacggacgatgtccacgcctatgtggtggaggccgatgccatggaggaagtgcgctggaagaatatgattgagtggggagagtagcggaagaactatgagccgcgaaaaatgcagcattagtataacgtatcataagtccttgtgcatatagcacccgctgtccacacaaggacttacaatacgttatactagtaccgccggacctaaatacgtactatgcagtacgcatttaagtccggcggcactagagaagagaggggcggtgcagtgaatcaggaaatgctggaacgtctcagtgtgatcacggaagaagagcgggaaatcttaaacgggcgcacagagattgacaggacaaggtacacaaagggcgatgagcttattacttcccgccgaacggaggtgagggaggctttccatattgacagcgggaagatgctggagcacggcaagctgatccgaatccggcctcatacccggttcgttcacttcccgaaacacaaacacaactacattgaagtgatttatatgtgcaagggggaaacgacccacatgatcgacggggagacggttatcttaaggaccggcgagctgctctttttaaaccagcatgccacccaggagattctgcctgccggagagggagatgtcgctgtgaacttcatcattttgccggagttttttgataccgcctttgagatgatgggggaggaggaaaatctgctgcgggatttcctggtgggctgcttgtgcaatgacacccggtacgccagctttctgcatttcaaggtggctgatgtgctcccggtgcagaatctggtggaaaacatggtctggacactgctcaatgaccagcctaataagcggagcatcaaccaggtcaccatggggctcctgtttcttcagctgatgcactatacagataagatcagccacacccgggagggcttcgatcagaggctgatcttccaggtgctgggatatatcgacgagaactaccgggatggagaactgacggagctgtcctccatgctgggatacgatatctactggctgagccggatggtgaaacggctgaccggaaggacgtacaaggaacttttgcagatcaaacggctgaaccaggccgcgttcctgcttttaaatacgagactggcagtggcggatgtggctctggcggtgggatatgacaataccagttatttctatcggatttttaaggcgcggtaccagatgtcgccgaaggagtatcggaagaataacagggcgctgtgaggatacggtattatggcacatctctctcctcctccagcttaccggactgccagagcaggaagaagagaagcgcaattcctgccgggacaccggctatgagggggagggtctttaacgcatcgcttaccatctggccgatgaacagtgcggcgatcagcgtaagggcttttccgtggccgttctgcctcctgctggaagacagtgtcaaaaagagataaaggagcggaagcagcagcgcgaactgcaggaaagcgccgggaatatcatccttcatctgcattctgaaataggaatggtttgcgtccgcgaatttctgcatcaggatggtgccggcctgcccattgaaaagggaaaacgccatgaccgccgcgaccgcagtcagacgcgagaagatccgcagccatggattgggctcggccaggcgccagagctcattctgccgggcgtccggcttttccagcatatggttcatcccgtaaaacagtcccaaaagcagggaagctgcgtaacagatactgatgagcaggacgagtaatcccgcttttttatcgatgacacggcaggcggaaagcgggagaatcaaaagcagcccattcagaatgatgaaaaatgccgccgctgtccgtatctcataaaatactgcctgaagctgccattttatagatttccatactctaatcatgtttgatctcctccagataatactgttccacggatttgtggtgcctcattctgatttcttccgtttccatctgccagacacgtccgtcagcgaggaatatgacctcatcgaacagagactccagatccttcagcagatgagtcgccatgacgatggagctgttgtctgccatattctccaggaggaagcgcttcatatctttcttgaaatacgggtcgattccatcaaagggctcgtcgaaaagatagaggcggcttttcctgcacagccccagaatcatgcagagccgttcctggtttcccctggaaaggcggcagagccgtgtcctgcggtcgatcttcgactgctccagcagcatcagggcgcgttcccgatcaaagtcgggataaaaatcccgatagaagcctgcacagtcgtccgcggtcatccattcgtaaaagtgactccctgaaagaatgtaggaagggggggcttcctcgcggatgatctgcccgccatccggccggagcagaccagccatcaattttaaaagcgtggactttccgattccgttgtcacccacgactccgataatccggttttcccggaccgtgacagaggcgtgatccaagaccctccagccatttcgttttttaatgacatcctgcaaacgcagcagacaggtagatgccgctgttatatcctcagttcttatatcatcttttctcatatcctcagtcctcatatcctcagtccttatatcctcagtcctcatatcctcagccctcatatcctcagccctcatttcgggcctccctccagttcctgtgaaaccgcagctctgatctggtcatctgtcagcccgcagtttctcatgcggcctataaagtcctgtatcaatccagttaccatgtcttccgacagcttctcctgtatatcaggtcggacaaagctgccgatgcccttccgggtcacgatgattccctccgcctccagatactggatagtccggtggatcgtgaggggggagacctcgaaaagcactgcgtattccctcacggaaggcagtttctctccgggctttatggttccgtttatgatttgttcttttatgaaggttccgatctggatatagatcggctggtcattttgaaaatccatggagaggcctcctattatactgttatatatatgtataacagtatagcggaaaaagacggagctgtcaagtttgaatcggattcaaagtttgcaggaaatacggcggaagcaaaaataatcctcctgtttccatagcagagcggctgaggggtaaaaaatagttcccggccagctcatcacattttcgtgagccggccgggaactatatggctttgtcatggtattagatttttacatcaggccaggagcctgtttgtatattcattcctgctttctgcacgccctggcaccctgtcagacagccgtctgtcatctacaggctcagatcctttccgccatttacccggttgaagatcagcaatgaaacgaccgtcagaaccgtcagtatggtggacagcgctgccgctatgccgtagttgcctcgtactacctccgtgtaaacggcgaccgtcagtgtctttgtcttgcctgtatacaggatgatggccgtggacagctcgctgatcatggtaacccagcttaagattgcgccggagacgattccggccgtcatcatgggtacggtaaccttgaaaaatgatttcatcttcgatgcgccgagggagatggccgcttcctcgatgctcatcggaatctgctgcaggatcgccaccgaggagcggatcgtatatggaagccgccggattacgagggcgacgaccatgatcagcatggtaccgcttaacatgacaggctttttattgaagccggtaagaagcgcaataccgagaacggtgccgggcacgatataaggaatcatggagatgatatccaccgtgctggtgagcgcgttctttctgcggacgactaagtaggcgatcatgatcgccagcaggactatgatgacgagggcgcagatcgggatgataatcgtgttctgaatactccgtcccagctttccaaacgcggaagcgtagctttccagcgagtagccggggacgaagatctttccctccgtctttttgaatgaggtgtagctgacgtatatctggggcagaatcgcgattcccacgaccagataggaggccgcgtgagccaggaagccggccagccctttcggcgccttctcctcgatgggatgcagggcgtttaaggaaaatgcgttcttattggacacgtacttctgcgccaggaagacgacagtggtgacgacgatggcgataaccgcgatggccgccgcaaatccgtcgttgccgcccacctcgttgatgaactccgtatagaggacgaccgggaaggtccggtacccttcgccgattagcatcggtgttccgaagtccgcgaaggaacgcatgaataccagcagggccgcggccagaagcgttggcatgattaacggaatgacaaccttgaaaaagcatttaatgccggaacagcccaggttgttggccgcctccaccagggaattgtcgatatttttgagcgcgcccttggcgtagaggaataccagtgggaacagctgcagcgtcatgacgagcacgatcccgccgaagccgtagatatccggtatggtgattccgatattcttgaaaaatgtagtgatgacaccgcttctgcccaacagaaggatccaggagtaagcgccgataaacggtgcggacatggatgccacgatgatcaggatgttcagcagagattttccttttatcttataaatggagaagatataggctaacggcgttccaatcgcaatggacagaaccgtcgccgcgatggacaccttaaagctgttgaacagggtgttgaaatagtaactcttagaaaagaatttggtaaagttggccatggagaactggcctgtttcggcatctatgacagactgctgaattaagtgggccataggataaatcagaaacagggcataaactgcgatggtgcacagcgtgatgattccccatatgtccagccggaatttgctattatccttcatagaatgcctcactccttacgagatttacactgccttccttgttaaagacattgattttatgctttttcacctgaagcagtaccctctgtcccggtttcagctcgtcttcgatggaagactcctcgacgatctccactgtcttctgtccgtcgtcagtctccacaaaatagtgtgtatttaaaccgagatacgtatattcctttacgacgccggagatgccctctgttccatccggggagatgacgaattcctccgggcgcacggagcataagacctcctggccggccgtctgttttaagcagtccatctccacccggtatccgttgccgaaaacgatagagccgttctccacccgggcgggaatgatgttggttctgccgataaaggtggcgacgaagacattctttggtctctggtatatgtccttgggagtgccgacgtgctgaatgacgccgtccttcatgactgcgatggtatcgctgatggccatcgcctcctcctgatcatgggtgacatagacggtggtgatgccgacatccttctgggtgtggcggatcacgcttctcatctccagacgaagcttggcatccagattcgacagtggttcatccatcagcagaacgtccggggtgatgaccagcgcccgggccagcgcaacacgctgctgctggccgccggagagctggttgggcatacgctcggcaaactgcatgatctgcatcagatttaagtatttatctgtctcagtcttaatcttttctttttcaatctttctgttttttaaaccaaaagcaacgttgtcgcgtaccgtcatattggggaatatggcatagttctgaaaaaccatgccgatattccgcttgctggggtccatatcattgatacgggtgtcattgaaatagatatcaccgccctcaatggagttgaatcccgcgatcatacgaagaagtgtggtcttgccgcagccggaaggcccaaggagggtaaagagttccccgtccctgatggtggcatttaagtccgggatgactgtgttattaccatacttcttaactgcgttttttataataattttactcatctttaacctccggccctctcatttactctacttggatgactctatgcttgtgaaaatatcggtatacttgttcacgagctctttcttatgagcgctcacatacgggatatcctcttcgattacatagatgtcagacattggtgtcatgaaatcactggttttcgcgtcttttaataccggacggttggtcagggttgttccccagatattctgaacttcctcgctgatgatgaagtcgataaacagctttgcattatccatgttcttcgcaccttttacgatggttgcggatgccggaagataaacactgccttcctttggatagatgatcttgaccggagcgccgtcctttacaagctgcgcgcacggatcttcataggaaaggcccaccagatactcgccgtccgcgactcccttgtatacacctgaggagctctcgatgatctttccgtcgatattggtaaagagatcttccacgtatttccaggctgcgtcgtcctcatatccgcccatagccagcagaatgttggtcagctgcgcaaatgcggaggaggagttggccgggtcggccgttgcgatcttgccctttaattccggatttaacagatcggcatagccctcgaccttgatatccccgattaagtcggtgttgacgattaagcagctgccgtcgagtacgttgccagtgatgaagccgcaggtattcttgtaggcgtcgagtacgccggaatcgttaggagatacgtatggttcccagaggtcttcattgtcaaatgccagggaccaggagccgccgaagagtacgtcggcgtacggatcatttttctcggactggattctcttgaccagttctccggtgccggcctggatcacttccacgtcaacgccgtacttttcttcaaacagcgggattgtcgcgttcatgagtccttcggagttgggagagtaaaccaccagcttgccgccgccctttttcgcttcaggctctgccgcttttgtatcgcccgccgcctcggtgcctgcttctgccttcggagccgccgttgtcgccggtgtggaagaggaagaagaacagcccgccagagccgctgccgtcatcgtgagcgccattgccaatgcaattgtttttttcatagtaaatcctccttcgattgttgtttgtatctctattttagtaaatatgcataaaagataatacctgaatttccgaacaaacagcaaaaataccgaacacatcagagagatctgttcggtatttttgtatgtatccacggtgtacaagttcaaatgcctttatataatctttatacggtattcttttggggagcaacccatgtatttcttgaagacgtagctgaaatacttatagtccccgatcccgcatttccatccgatatcggaaatggcattcccctcgtccgtcagcatggccagggccttctggatgcggtaccggttcagatactcgattacggtggtgcctaacgctttctggaaccgctggtttaaatagcgctccgagtaatgcagctcttcttccaggtcggccagcgcgatcttctgatcgtagtttctggcgatgaaatcgagaatctgagaggcgaccgggtccatgccgcccatggagtccggctccggtatcagaacggaatgcttcagcttttcccgatcctccatctcacggcggagaattccgatgtttttcagttccagggccgcccgttccagcgcctccttcatttcctccatatccaggggttttaaaacgtagtaggagacgccgtttcggatggcttccctggcatactcaaagtcggagtagccggtcaggatgatggcgacgtaatcataggcacatttcgtcctggcgatcatctggagtccgtcctccaccggcatgttgatatcggttatgacgatgtccgggttccgctctgcgatcagaacgccgccctcttccccgtttcgtgcctccccgacgacactgcagttaaattcctcccacggtacggagtttttgattcctcttcggatgatgtcctcatcctcaaccaatattacactgtacaaggtttcctctccttattttttaatctgatatccacccggaaatattccccttcccggctgtctatggtcatctcgctgttgtccccgtattccagcacaatgcgccgggccaggttctggaggccgttgtgctcagttttcagttcttctgattttaacatggcccgcagggtctccagcgtggagcggggaacgcctgggccgtcgtcctcgacgctcagatagaggtagtcttcctcacaccatccgcgtatggcgacacggatttccatcttcttcttaaaaccgtatttaatgctgttctcgatgatgggctgtaaaagcagcttcggaacacggtatctcatgcactcgtccgcaagggcggtctcgcagagaaaacggtctccgaaccgggtccgctggatatagaggtagtcttctatgtatcgcatatcctcaagcaatatgacatcctgcttcgtgttgttgatgctgtagcgcagaatatgcgtgaatttctcgatgaggtgagcggctttgtcgggctccgacatgatcaggtacttgatggtgtccagtgtgttatagataaaatgaggattgatctgggtctgtaggttgctgatctcgatcatgctgtttaaacggattaaatcggtgttgcgcgtgttcagatcgttgatgctcttaaccatgcggttgatctggctggcgatctcctcgaattcatctccggtatggatttcgatcacatggccgctgtcgccgtggcgtatgatcctcatctcatcggccagcatgccgaccgaccgggcgtttttttccgccatgagtttggagagcctcaaggtcatgataaaccagatcacgcccagaaacacgatggtcaggataccgatggtaagatagagcacatttttcgggtaatagataaaggaatagagaaacacgccctcgtccttcataaaatgggacgaaagcagataccggtttccgtgaaggaagaccatgcgctcctgtgattcatttctgaatttattggtattccgctccggcagaaatccctcgcgggagcagaagatgatatccccgtttgcggtggtgatgatgttgtcgtactgataatcggaaaacagccgggcccagtcatggccgtttaaataggcgcccaagaacccgatgagttcgccgccgcggtaaaggggcttggagaagacgtattccgaggtgtccccggtaaaatagtagacggtgtgatagaggtccgggccattttcggctgcgttgtcgcagacaatgccgttaaatgcgatccggtgcaggttcatatcatcggcgctgtagctggtatagacgatattccggtcccggtctgccagaattaagttcaggcggatcgggctgtctacattgtacttgcttaaggagtaatgcacctcgctgccatccgtcccatcctcgatacacttcgtaaaaacggagttattttccgtgtcgttcaagtaggaatccgtggcgtaataagccgtttgaaaggtgctggacaggaattcaatgtgtgcctgcacattaaaccgagtgtttaaatagttaatcccgaaaatggcggctgaaaaaaacaggcatccgatgaaaaccaggaaaacaatatttctggttgccgctttttccagctgtttttgaaaaatagtctgttcccgtttctgttttaatgccatgacggcctcccatcgaagggcctgcggacagtaacggtccgcagacagatattcatacatgcagtatagcacaagaataaaagggtgtacacaagcggcgtccaaatctatttgagtaaaaaaatatcgacttaagtaaaatggagaaaatatcccgttttgtaaccggtctgtaactgaacgtccctataatcagaaaccggacttcaatggaaacaggaggaaatggatgaaaggatattcgtatttaaagagggcgtttacatggctgcttacgattgtcatcacagtatcgtatgtgctgccggggactgcggtaacggcatgggcgtcagagaaagaggaggcgggagagtatcccctgctgggctatatagatgacatcaccgttctgttcgacgggaaagaagcggtaccgggagatgaattcagtgatctggacccggaggaaacgtatgtcgtatcggcctcgtatcagagcggcgacattgcggaagcgctgcttgacggagcgctggcggtgggagtggaatataagattccgctgccggatgtatttccggtttccggcaatcaggaaacgctggagcttgtcctgaagaaaaatgagacaaatgcggagctgtatgaccgccttggagaaaacaaccacgtgataggaaccgtgaccttcaccttccgtcaggcggtgccggccacggcttctgacagtaccgccagccgcggcagctttgcgtctgtgcggttcaaccgctcctttgttgaaaagattcagcggctgaacgggagaatacagcagaagaaggcatctccgtcggtggccacggtctcccagctgtcggacgacgagccggaggaggacatcatcgaggtgagcgacatctggttctccttccgggtatcggggagtgtggagtggagcaatatctgcagtaaggatgtgtatgagacggttcttccatttgagggcttcggtgacatttcccttcagtttcaggagcctgttctggataagaaggagcagataaagatatcaaaggaattttccttccgggactcgagaggagccgcggtctgggagattaccgcaaagaccacaaatggtgcaaaatttccggagggcaccgtgatccatgatacctacagcgacaattccgtctggctggaggatgaggtaacggtcgcttcagacgggaaagcacttggcactgaggactatgcaatcgaagcgataccggaaatacatggttttgcggtgacgctcctccgggatacggtctctccggtgaccatgaccgtaaagacgaaaccggttatggatctggatgccgtagacaaaccggttatggatctggatgccgccggagccgtagacaaaccggtgacaattaaaaatcaggccggtattaccgtcggcgatctggcgcttgatacggccgatcagacgtatacctatccggcggcattgctgcagaaaacggccggggagatgaaaaacgggattctgccgtggacgctgacggtgaatcccggcggggcatatctggaggaaggcttcaccatttcagatgaactgaatgagaaactgacttatagcggcagtttcaaagtgtattcctatgagggaaaagacaacagtttgaagctgactgagctttccggacacggaatcacggacgcctacgatgaagagagcagggtattaagcttcgatataccggaagggcttgatattcccctgaaaatagtatttgagactgcgtatcaggagggattaaacggaggcgaaacgatcaccaacgtggcgacggcctatgtggcagaccatgtgatccgctcgaagccggcagcaggcagtatcccgggcggccaggtcctctccaaagagggaaaatgggatgggcgtcagattacctggtccatccatatcaacaaacaggaaatgccgcagaaccacgttatcatcaccgatttgcttccagtcggccaggaatttaccggaaccgtcacagtcagtgacgaaggacagcctggcggagcagtggaactctatcgtttcggcggtgaggaaccggagagtaccatggcggtggagctggaaggaaaggaaacacagcttacctttacccgcgggatcgtggaagaggacggggaggataagggaaacgagtactttaccattgattttggtgaagatttcgtgatggaaaaagcccatgtcgtgactgtacacacctttttaaacgggcaggacaacgtaacaggcaaccagcagcgggcatacgtaaaccatgtggagctggaagccgatgagaaaaagatcgtcatggattacgatggcagcgtgaagctgacgccgcccgttgtgctcaagaagacgggagcctatgacggcagtacccagaagcttaactggaccatagaggtcaatgggggagagtttttacgcaagggctatgtgttgaaggactgtctggcacagccccatgccaacagcggctcctacccggttgcggatggagggaagcttaaggaccacaccgatatttcgtcagtcaggatagaagtgagggaaaaaagcagcccggatggaccagcttcgaaaacctggcatacggtgctggatacagagacgggaacctggaatcccgcggcagtttccgaaggctttgaactcacgtatcagacaggaagctacgaagtattaaaaggagccgggccggtaacggatggaaccgtggtagcttccgcggaagcggtggaagccatgatccggaatatcatgaacgacggaacgccggaagtgctggcattttccttcggcgatattgatcagtatttcaaagtgaccataggaaccacattcagaaagactgcgggtgaaaccatcaatcatcacgatgagatcacatacagaaaccgggcggaaagctggtacgaggggctgaagggaacgatcggagcggatggactttatcagtacaagggcatgcgccacatgatcgatttccggaagagttccaaagtggaaggcaaagatgccattctgtggaatatcaatatcaacgacgataagttcccggtggatatagaaaatgactgtgaccatgcgtcgtttggacttgcgccgggactctgtatcacggatacgcttccccgtggaatggaactcaaagacggccggatcaccgtaaaaaagagcggccaggaaataacaatgaccgagggtgttcattacgttctcaccggggagccgggagagcagacgctgattatccacattccggctgagtttaatgaggagggccaggcgcgtctggcagattcctttgtcgtgacataccgcacgcaggtgatgacgctggagggaatgcttctcaatacgccggtggtctaccagaacgcggcaaaatggagttataaccagtacgtttcaaaggagacctccagttcacagaagatcatcatgtatgatatgtccgccgatgccggaggcacgggaaccggactgaaaaaggcggagataacaaagtataagaccgataaacacggaaagaaccgtgtaatattcccaggagtggaatttactctggaaaagaaggttgacggaagctgggtgaaggtgactgcggccagaaccggagacgatggaaaagtgagctttgcagctctgaatcccaagaccgaataccggatccgggagacgggcggttatgagggatatgaaccgtcaaacgatgtccatatcgacttttcgaaggggaattttgcggaggacgtgatcaattatccgattgatgaggagccggaaacgccacctgaaacgccgccggtgacagagccagagacgccgccggtaacggagccagagacaccgccggtgacagagccggagacgccgccggtaactcagccagagacaccgccggtgacagagccagagacaccgccggtaactcagccagagacgccgccagtaacggagccagagacaccgccggtaacggagccggagacaccgccggtgacccagcctgaaacgccgccggtgacagagccagagacaccgccggtaactcagccagaaacgccaccggtgacagagccagaaacgccgccggtgacccagccagagacaccgccggtaacagagccagagacaccgccggtaactcagccagagacgccgccgccagtaactcagccagagacaccgccggtaactcagccagagacgccgccagtaacggagccggagacaccgccagtgacagagccagagataccgccggtaactcagccagagacaccgccggtaactcagccagaaacgccgccagtgacagcgcctgaaacaccgccagtgacagagcctgaaacgccgccggtaactcagccagagacaccgccagtaacaacaccggagaccacaccgccagtatcccctgaaacaccggaaaacgggggcgggagcagtcacgggagcagtcataattccggcggcagtataccgaggccgggacagaccggtaccgtaacggaggggccgggatatactggccatacggagacgattccggattcggagattccgttagcggcaatgccgacaccggatttaccgggaaatacggagattaccatagacgatggaaatgtgccactatcaggtctgcccaagacgggagagcgcagacggcctggctttagcctgtttattgccgccggagtacttggcctggcggggctggggctgaccggcagaaaaaaacggagaaatcgaactgagcgctagaggaatcagccgcatcaaatgagtataatacagggatctgtgaaagcaaatgcatacagatccctgtattttttatgtaatagtgaagttcccctattacataaaaagccctccgggcaggatgcacacatcgcgccagggaaatatggctgctgaagcagctgcgctccggcgcgagcgtccagcgagccggactctttgttctatttagactaaaaaccaagccatactatgaaatggaaactccccggcgcctccaacctgcaaataaggacacattttttaataaaccgagacctttttttctgcctgataattcgataaaatatgattagaaaatatcggagggtgatacaaatggagaactattaccttgcagtggacatcggcgcctccagcggccgccatatcctcggcacagtgaaggacggaacaatcagcctggaagagatctaccgttttgaaaacggcatggagaagagaaacggccatctctgctgggatgtggaatccctgtttcacgagatcaagatgggaatgaagcagtgcgcggcgctgggaaagattccgtgcagtatgggaatcgatacctgggcggtggattttgtcctgctggacagagaaggacggaggctgggagacgcggtcggctaccgggatgacaggacgaagggcatggacgaaaaggtatacgaagtcatttctccggatgccctgtatgaaaggactggaatccagaagcagatattcaacaccatctatcagctgatggcgatgaaagaggaacagccggaggcactttccggcgcggagtccctgctgatgatcccggattacttccattatatgctgaccggcgtgaagagacaggaatatactaacgcgacgaccacccagctggtcagtccggtgacgaagacgtgggactatgagctgattcgtcagctcggatatcctgaaaaactgtttaccgagctgtccatgccgggaaccgtggtagggacgctgacgaaagccgtgcaggacgaggtcggctttaactgcaaggtggttcttcctgcgacccatgacacaggctccgcggttatggcggtcccggttccggaaaacggggaaagaaaaggccatgagactgaaaaaacacatgatacggacggcggcctgttatacatcagttccggcacctggtccctgatgggcaccgagttaagcgaggccgactgttctgcagaaagccggaaggccaatctgacaaacgaaggcggttatgagtatcgtttccgctatttgaagaacatcatgggcctgtggatgattcagtctgtaaaaaaggagcttgccgcggccggagaagcctattctttcgccgaactttgccgcatggcgtcccatgagaccataaagtccattgtgccctgcaacgacgacgtatttctcgcgccggagagcatgacggaagcggtaaaagcgtatttaaaagtatccggccaggaagtaccggagacggccggtgcgctggcggcagtcatctacaacagcctggctcagtgttacaaggagacggtggaggaactggaagccatcacaggcaggacgtatcaggctgtgaatattgtgggaggcggttccaacgcagagtatttaaaccagctgactgcaaaggccacggggaaaacggtatacgcgggtccgggcgaggcaaccgccatcggcaatcttctggctcagatgatcagagccggagaattccaggggcttacggaagcgagagcggccgtataccattcatttgagatcagcacatacgaataacggaggaactgaggatgatacataaatcatttaaaatgcatctgtatgaaggcatggccgaagagtatgagaggcggcacaaccttttatggccggagatgaaggacatgatccatgagtatggcggccataactattctatttttctggacagcgagacgaatgtgctctatggctatatcgagattgaagaggaagcaaaatgggcgaaatcagcagacacggctattaaccgcaaatggtgggattatatggccgacatcatggatacaaacccggacaacagcccggtgagtgtggatttaaagccggtattccatctggactgaccggcggtacagataaaatcagaaagaggagaatgatatcatgacagtaaaagagagatatgaagccgcaaaggaaatttaccgtgcagtcggtgtggatacggacgccgccctggaggccctgaaaaatattccggtttccatgcactgctggcagggagacgatgtaattggatttgacggggcaggcgcactttccggcgggattcaggcgaccggaaactacccgggacgcgcaaggacaccggaagagctgatggccgacatggacgaggcgcttagcctgattccgggaacacacagaatcaaccttcatgcaagctatgccgtatttgaagagggcgagtgggcagacagagacaagctggagccgaagcattttgcaaaatgggtggaatttgcaaaggaaaggggcctcggaatcgactttaacccgaccttattctcccacgcgaaggcggaaaatgccacattatccagtgaagttttagagatccgcaaattctggatcgaccatgtgaaggcatgcatccgcatttccgagtattttgcaaaggagctggggacgccatgtaccatgaatatctggattcctgacggattcaaggacattccggcggaccgcacggctccgagagcgagactgaaggattccctggatcagatcctttccatcgattacgacaagtccagcgtgtttgtggcggttgagtccaaggtgttcggaatcggtatggaaagctgcacggtcggttcccatgagttctatatgaattacgcttccaagaatgatattttatgcctgctggacagcggtcactatcacccaacagaggttgtttccgacaagatttcttccatgcttctgttctttgacaaggtggctcttcacgtgacgagaccggtgcgctgggacagcgaccatgtagtcttatttgacgatgagacgagagcgatcgcgggggaaatcatccgcggcggcgcagaccgcgtcttactggccctcgatttcttcgatgccagcatcaaccgcatcagtgcctgggttgtaggcatgcgcaatatgcagaaagcgctgttaaacgcattgcttcttccgagcgccaggatggcggaacttcagaacaacaggcagtttacggaattaatgatgctttccgaggaaatgaagacctatccgttaggcgatgtatgggattacttctgcgagcagaacggcgccccggttaaggaagcatggtttgaggaagtaaagaggtatgaggccgacgttctggcaaagagaagttaaggatgcaatgcggcctccgtgccgttatggaatagaaaaaaacgagaataaaaattacaagaacagaaagaacaggtgtaaataaaatgaaagtaacagaagcagaatttgtaaaaggctttatccgtctctgtgacgacggtttcaaacagaactggcatgaaagaaacggcggcaacttgagctaccgcatcaaaccggaagaagtggaatccgtgaaggaagaattaacagacacgaatccatggcagccgatcggaaccagcgttccgaagctggccggcgagtatttcatggtaacgggaagcggaaaatacttccgcaatgtaatccttgatccggcggccaacagctgcatcatcgaggtagatgaggcgggagagaactaccgcatctgctggggcctggtgaatggcggacgcccaaccagcgagctcccatcccatctgatgaaccatgaagtgaagaaagaagttaccaatggaaagcaccgcgtgatttaccatgcgcatccgaccaatgtcatcgccctgaccttcgttcttccgctggaagacaaggtatttacgagagaattatgggaaatggctaccgagtgtccggtcgtatttccggatggcgtcggcgtagtcggctggatggttccgggcggacgcgacatcgccgtggccaccagcgaattgatgaagaagtacgacgttgccgtatgggctcaccatggcctgtttgcctccggcgaagattttgatctgaccttcggcctgatgcataccgtggagaagtccgctgaaatcctggtaaaggttctgtcgatccgtccgaataagctgcagaccattacgccgcagaattttagggatctggcaaaggattttaaggtaacacttccggaagagtttctgtacgagaaataagaggccttactgccatggagaggtcgtgggaggcgcctggttccagtcttcggacatgatttttatgaatcagctcgtccccttctcctgtgcgggctccggaaccgttccagggctcgatgcagagaaacggcgccctgtccgggtacacggtccaaaatgcaatcgtctcaaagtccggataggaaacctcgacgccacggccgctttcccgatggacgagagagacccggcgtgatgcgatttcgggaaaatagagggcattgtcctggaagagttccctggaaaggggaatgatacggccatgcagttcgtatccgcttccgccggagagatattctcccaggagacggtcaaaggacatggcataagtggattcctctttctcaaatacaagacagtagtcctcgaagacagcgtcttcctccataggacagcagaagccaggatgggctccgatgcagtaatacagggcagaggagtccttgttggcgacccggtatttcaggagaaggctcccatgctgcagctcataggtcagcgacaggcagaaggaccagggatacatggtttttgtgtattcgctgtcctgaagaaggaaggatacgctgcagtctgtccgtgtggtcctgtgaaactccatatccttgcagaaaccgtgctttggcaggctgtattcgcttccgtctatcacgatcctgttgtcccggcagcctccaaccacgggaaagaggagcggagaacagcggtcccagaagcgcggatcccgctgccagatatattcttttccactgcggtcttttaaagaaacaagctgtgctcctgcgctgtcaatcaccgcggtcaattctgaatttctaattgtagtcaacataaatcttccccatttctgtaaattgatacgaatactataccatcctttttgcttgccggaaacaggaatatcgagtatgatagtgatagtgctcccgggagtactctagtcaggaaaggaggcttgtcctatgcttcgcattgaaaacaccggaaaatctcagatgaaatccagaaacagggttcgcgtatttcgcgaaattttaaatcatgaaggcatttccagaaaacagctggagaagcgcctgggcctttctgcgccatccgtcacgcgggtagtggaggaactgctgcgggaggggcttatttgtgaggaaggcaccgaacagacccatatggggcgcaggccggttatgctctgcgtcaaaaagaatgcctattacagcgtcggaatgaatttaagcagatcgaggctttactactgtatcaggaacctgggaggagaaccggtgcattccggtgagataaggcttttagggaaaacgaaaggagatcagctcttaagcctgatggaacatgccgtccaggactgcttagagactgcaggcattgagaagaaacaccttcttgccattggtattgcctcccgcggaacggtaaacgaaggaaagggaagcgtaatctattcacccgactcaggagaggagatccatgttaaggaatacatgggagcgcggtatgactgcgagattctcgtggaaaacaacgtgattgccgacttaaaagggcagtatctggacttgagcggcaccaaccggaatctggtgtatctctacatttccgacggtgtcggaggcagcattatctgcaatggccaggtgatcgacggcgagaacagcatggcaggtaagttcgcccacatccttgtggagagcggaggaagacggtgcgcctgcggaaaaagagggcatttggaatcgtatgtgtcaaagccggccatggaagaggcgtacttcgaagccagcgggaaacggctggagctgacggagatctgcagactggctggcgagggggagaaggcggcggccgcggtccttaaggatgccattgacaagctggcgatcggcattaatcagattcttctggttgtgaaccccggaacgcttgtgttgtatggcgatctgttcgagagcgtcgatgggattctggagcgtttgaagcagaagacgaaggaactggcctttacggaggagatcgccgacaactgctggatggtgagagagacgaaaaatgtccgaattgaggatagcattgccagactgtctgtggagcgggctttggagattattgtctaaactcaataaaaaaatataatttcatattgaaataatatagagatgtgatataatgataaaaagacaacggggtgtgtcttaaaaatttaactaattaatttcaaaatgaaattatatgaaaaggagaggcagcaaatgaaaagaagaaatttgatggcattggtacttgcgggagttatggcggcgtcggttatgggatgcgccagccagagcggagcgaagaatccgtctgagacacagaaggaggcggccaaagagggagcgtctgatgagagtggagccgccgacagcgccgtcgtaccggccggcagctggaaaccggaccatgacatcacgatccgtgttcccaatgcagcagggggaaccatggacacgatcacgaggattttgggacagggaattcagcagagcacgggaacgacggttatgattaataatctgaccggagcgtcaggagctattgcagccaatgatcttcttgccaaggacgcagatccctgcgagctgatgacgtctggaatcgcgctctttacactggcgcctctctttaatcaggatattaaggtcagccttgacgatttcgccattgtatccggcatggtatctgaggattttgtactctgtgtgaacccggagaagagcggcatccataactgggaggaactgaaggcctatggagagaaggagcggattctgttcggctccaatacacctggaggaacgactcatatgctgggcacggcgctgttcggagaagcgggcttaaacgcggaggccgtgacatcggacggaacgaataaggatatgctggccctgacctccggtgacgtagtctgcgccattggcaatgccagtgcctgtcagcagtttatcgaagaggggacggccgttcccatcgtggtattttcagcggacgcctatgaaggattcgaaggttttaccgttccgtccgtcgtggatttgggatatgatattcagttcaaatcctgcaacttcctgatggcgaaaaagggagcggatcaggcggctctggatcagattcatgacatgattcaggcctatacggaaacagaggaatgtaagaaactggccgagagtgcaaaatacgtcccggatattgccgacggcgagaccgtccgtgccatgattgaggattccgcaaaaatgtgccaggaaatctacgaaaaatattatcactaataaggcagggagaaagcgatatgaaagtgaagtacaggacaaatctgtgggccggaatcgtaagcgtgatcttcggcctggcagtcctctggctgattccggctcagataggtacagaatattcgtcaggaaacagcctgacttccagggccgttccaggcggagcagccattctgtttatcgtatgcggcgcggcgctgatcgtccagagcctcattttaaagaaggacacggtccgggaactgaatctggcaaaagaaggcaaggcgttcctttacatggcggtgtttgggatctatgtgatcctgtttgactacagctttattgtggcttccatattcctgggagccgcaaccctgctttttacaaagagtaagaagaagctgtattatatgatcgtaattatcacggttttcgtcctgtatctgctgtttacgcaggtacttcacgtgagactgaagtaggaggccgcaaatgaaggaaattatatttcaggcactgccccagctgtttactctggagaattttgtatttgtaaacctggggatttttatcggaatcattttcggctccataccagggctgaatggcaatctggccattaccgttctgattccatttacatttaaattaggcagtgttccagccctgctgatgctgaccgctatctttttcggctcgaatttcggaggctccataacggcgattctgatcaatacgccgggaacgaacgcagcggcagccaccctgctggacggatatcccctgtcgaaaaagggaaagaccaggaaggccctggacatggccctggcggcgtccacctttggcggactggtgagtgcgttgtgcctcctgtttttcgcgccgcagatcagcaaaatcgccattcatttcggagcaccggagtactttgcactggcggtgttcgggctgtccgttatcgcctcagtcagcggaagaagcatcttaaagggtgtgatcagcggggctttcggcgtactgatcgccacggtgggaatcgatgctgtcagcggcgttacccgttttaccttcggcagtcttcagatgtataacggaatcaaaatgctggcggttttactgggcgtttacgcgattgcacagatgatcagccgtgtaaacggtacggaagaagaggaagcgggcacagaactgaagaaggcagatccctcggaccgcctgacgctcggcgaattaaagagtaccgttcccaccatactgaaatcctccgcgatcggagcgtttatcggagccattccgggcacaggcggggcgatcgcctcctatatcgcttataacgaggccaaacgctgcgcgaaaccgggcgagaagttcggtgagggagaattaaagggaatcgccgcgccggagtccgccaacaatggggcgaccgcggccacgctgattccgctgcttacactgggaattccgggagatgcggtggcggccacgctgttgggcgcattcaccatgcatgggctggtggttggtccgaagctgttttccacttcggggccggtcgtttacgccattttgatcggatgcgtgatttctcagattgtgatgtttttacagggaaaatatttgcttcccctgttcgtaaaaatcacacacattccgcaggagcttctgacggcgctcctggtcgtaatctgctgtacgggagcattttcactggcgaattcttcctttgacgtgagggtcatgctgattttcggctgtatcgcttatttcatgcagaaggtggaactgcctcccgtaccgattattctcggaatcgttcttggccccatcgcagaggccaatttaagaaattccctggtcctttcagacggctcctggaccatattctttaaacgcccaatctgtctggcgtttattattctgacctttgttctgatctggcttttaaagaagaacgacaaaaagcagcggagcatggaagcagaatttctgaaaaaatacggagaaaatacggagaagtaaggaaaggaaccactatgcattacaaaaaactatggacggatttacacagcaatattcatcacaatcagatgggagagctgaaccaatggattgaacacgcaaaaaagaccgttgatttctggccggtcgcctactatcccttctatatgaagcgtaccgaaacaggggcaggcctggaggatctatatgacagggaacagatcgaacaggactgggaacagctccgcgaggcggtaaaacagcaaaacgaagccggttatccgatgtttatgggctatgagtggcagggctccggagatgacggagaccataatgtgttctttttggataatgagcagccaatgctccatcccatgcggtacgaggaactctatcaggcgtataaggacaggtcggcgatagccatcccccaccatgtggcctaccagctgggcagcagggggaaaaactgggagacgcaccgggaagccttctctccgtttgcggagatctattccagccatggctgcagtgaaaatgatacaggcccttttgatatggagcgccatctccacatggggccaagaaccggagagacctgttatgagagggggctcgagaaggggtatctggtcggcatgattgcctctggagacaaccacaatgtaccggcggttcacgatcatggaaccatgtgcgtgctggcggcggacggctcaaaggaggcgatctgggaaggcctgcaaaaccgccgggtatatggcgtcagcagaagccgtatggatattgattttaccataaacggaagcccgatggggtctgtggtgaagccgggagaagggacgcttgcatttgccattgaggcggcggacgccattgaccgggtagagatccttcggaacaatgttctggataccatggcggttcatgcgggtacctgggaagagactgagtataccggcgtaagaaagtataagtttgcagtggagtttggctgggggccgaatcccaagttttataaggaccgtctgatgaaaacctgggatgggtctctggaagttccgggccgtctctgctcggtgcagaaatgctttaacagctttggtcaggagctttgcaatgtgacggagaaatcctgtgaattccatatgactacctatatgagcaccaccacaggccactggatgggaccgagtacggtcgtgaaggaaggttttgtgtttgaagtggagggaaagccggaggatgagatcgtgctgaaggtggaccgctacgtctaccgctttacgcttaaggaattgatgaaatcctcgagaattctcgcgcagtatcaggagagcatggatctggctgcagaggtctttggaaatgtggaacactaccgcgatgatttctactggcacaacgcctataagaccagaatccgccaggcagtgccggaagaggcgtatacgatgaagtatgaaaagaaggtgacactggaggcgggaagctgctaccggctccgggtgcacttgagaaatggagacaccgcctgggtttccccgatttttgtgcgggaataacagataaaaagagttacgaagagtgaaggcggattcctggaaatggaatcgtgagagtggcattcacttttcgggactctttcttattaatatgtaaacttaaattgtaatcttaaaatgtaatcttaaaatgtaaatttaatggcgcagaatggaataccactctgcgccgtctgattaccggttggctgattttaattcattatggttcgtctgccgtgtcttccacaatcgtagtggattcctctgcggcaaatttcttcaatgcatctccggttccctcatatatctcttcgacttcttctgagtctgcttctttatcttctgtatctgcggcctgctccggttcttctttgaacccttctgtggcgccggctgcgtagtcgagtccgccgtcttcggtaatatcttcttcctcctcgtcgtcctctgaacggtccatggcggaatcaagcatatccttggcggtatcggcaactgcggaagcggcttccctggccgtgctgttcacgatgctggctgcgtctttcacgaggttcttcgcggcagaagctgcatccttggctgcgtcggccatatcggcggcggctaccttgaattcatctttgtctgcgtgaagggatacgtagttcctgttcattgtgctgtcaatcttggaaatgtcatcattcccgtcatcttcaaaatcatgaaaatcttcttccagttctttatggaaagatttatatttcgtaaaataagagataccggccgcaacggcacccgcgatggtggcgaaagccactaacttcccaaaaccattacccttttttgccatgtgaaacactcctttcatttgattcttattgtaatacttataaagaaaaaaataaaggtatataataagaaaatttctataaactatgtaggaacgggaaaatgctctcagttatggaacgaaattgtaaaaaatatataaaattagcactcaactattgacagtgctaataatgagtgatataacttagtatgtgaataaaagaagtttccattgcgaaacaaaaagaaagaatcaatagaaacagtatgaggaggaattgcaatgaaattagtaccattatttgacagggtagtattaaaaccattggttgcagaggaaacgacgaaatccggaatcgttttaccgggtcaggcaaaagaaaaaccgcagcaggcggaagtaatcgcagttggaccaggcggcctggttgatggcaaggaagtaaccatgcaggtaaaggtcggcgataaagtaatcttttccaagtattcaggaaccgaagtggaaggcgaaaacgaaaatgacaagctggttatcgtaaagcagaacgatatcctggctgtgatcgaataaaccgtatccctaaggcaataccgaaatcataacaaaaacgatagatagaaagaaactggaggaatgaaatcatggcaaagcagattaaatatggtgtagacgccagaaaagcactggaagccggcgtaaatcagttagcagacacagttcgtgtaacattgggaccgaaaggaagaaacgttgttcttgacaaatcctttggcgctccgctgatcaccaacgatggtgtgaccattgcaaaagagatcgagctggaagatccatatgagaacatgggcgcacagcttgtgaaagaagttgcgacaaagaccaacgacgtagctggtgatggtaccactacagcgacagtgctggctcaggcgatgatcaatgaaggcatgaagaacgtggctgcaggcgctaacccgatcgttttaagaaagggtatgagaaaagctactgaggcagctgtagaagcgattgcaaagatgagcgagccgatcaagggcaaagcttccatcgcgagagtagcggcaatctccgcagcagacgatggagtcggtgagatggtagctgatgcgatggagaaggtttccaacaacggtgtcatcactattgaagaatccaagaccatgaagacggaattagacttagtagaaggtatgcagtttgacagaggatacgtttccgcctatatgtgcaccgacatggagaagatggaagccaacttagacgatccgtatatcctcattacagataagaagatttccaacattcaggagatccttccattattagagcaggttgtacagtccggcgcaagactcttaatcattgcagaggacatcgagggcgaggctctgaccacattaatcgtaaacaaattaagaggtaccttcaatgtagtagctgttaaggctcctggctacggcgacagaagaaaagagatgcttcaggatatcgctatcttaacaggcggcaaggtaatttccgaagagttaggctatgaattaaagagcaccacaatggatatgcttggacgtgcaaaatccgttaaggttcagaaggaaaataccattatcgtagacggcgaaggcagcagagacgagatcgaagcaagaatcggccagatcaagggtcagattgaagagaccacatctgattttgataaagaaaaattacaggaaagacttgcgaagttatccggcggtgtcgctgttatccgcgtaggtgcggctaccgagaccgagatgaaggaagcaaagcttcgtatggaagatgctttatccgcagcaagagcagccgttgaagagggcgttatcgccggcggcggttccgcttatatccacgctatgaaggacgttcagaaagtgattgacagtctggaaggcgaagaaaagacaggtgcaaagattatctttaaggctctggagtctccgttataccacattgtggcaaacgcaggtctggaaggcgccgttattatcagcaaggtaaaagaggctccggttggcacaggctttgatgcttataaggaagaatacgtagacatgatcgaggctggtatcctggatccgaccaaggttacgagaagcgcattacagaatgcgaacagtgttgcatctaccttattgacaactgaatccgttgttgctaatataaaagaaaaaacacctgcagctccggctccaggcggaatggatatgatgtaataacggaagcaaaagcgacgcatgcgtaatgaaaagagggtttgcagtgcttgcattgcagatcctctttattttgtttcataggaaagttcatcctgtgatacaaaaaacctccgggtgatgcacaacgcgctaagaaaatatggccgctgaagcgaccgcgctccggcgcgggtccggcttgccggattctttgttcaggaaagtacaacctgtaagatcatcgccctccggggatgcggaccgtgaactatatcatctcccttcacagaagaaaggacatcagtctatgaatgaaatgtatgcagaatggctcgtaaaacgaaaagcaccagcttatatgatgcttgtcaaggtattgatggttctggtatgtgtggtggcattctttgttgctgtatccccgctgctcggaattttcggaatcctggttctctttgcggcagcagcggcagcctactttgtcttccgcaacagcgaagtcgaatttgagtacctctatgtaagcaatcagctgacgattgaccggatttacggaaagaccaagagaaaaaaagcctgggaaggttccatggatgagattcagatcgttgcgcctaccggttccacggaagcgaaagatcacgagacaaataatatgaaggttctggatttctcttcccacaccccggacgccaagacatttacactgatcagccagtccggcagtgaatccatgaagattattttcgagccgaacgataagcttcttcactgcatgaagatgacggctccacgaaagatcgtggaccgcgtttaaggatatgccttgaacgtcgtttgaggatttgtttcaggataagctttataaggataaaataaaaaggacagatacatgatgcggattaggccgcgtagtgtgtttggcctttttttgtggcctttgggaatgggggaggagaagtgaagctaaaatggctggattggtgaaggggatgaaatatttacggacgaattaagcgtagatgatttgtaaaaaaaagtatgtattgataaggcgtatgggagatttttataggaatttttgtaaaacctaacatcgatgcttgacaggtgtgattcgaatatagtaagatagaaaacaagttccacagcattttcttgcctgtgaaattctaaaattctttatttcaatgcggtttccgcaaaaaaatcctatgtttagcttcaggagagttggtgatgtgtatgattgcttgagaaaaagtcttgtaatggcaaagcttttacagtataataagaacatctaaatgatgtaaaaactaaagataggaggagtgaaatgacaatagatgaaaagttggatttactctgtggaaatgttcagagtataaatgataatgtaattgtgatgaaaaatgatatggctgtgatgaagggcgatatagcagagctgaagagcgatatgactgaggtaaagggcgatatcgtggggttaaaaagtgatgtagcagagctgaagagcgatatggctgaggtaaagagtgatatcgtggagttaaagagtgatgtagcagagctgaaaagcgatatggctgtggtaaagagcgatatcgtggagttaaagagtgatgtagcagagctgaaaagcgatatggctgtggtaaagagcgatatcgtggagttaaagagtgatgtagcagagctgaaaagcgatatggctgtggtaaagagcgatatcgtagaattaaagagcgatatggctgtggtaaagagcgatatcgtagaattaaagagcgatatggctgtggtaaagagcgatatcgtattattaaagagcgatatggccgtggtaaagagcgatattgtagaattaaagagcgatatgactgtggtaaagagcgatattgtagaattaaagagcgatatggctgtggtaaagagtgatatcgtggaattaaagagcgatatggctgtggtaaagagtgatatcgtggaattaaagagtgatatggctgtggtaaagagcgatatgaccgtggtaaagactgatatcatagacctgagaaatgatatgaacaccatggaaggcagaattgatgctaagatggaacagttaaatgaaaatgtgaaggggattcgttttaccattgaaaatgaaatccgcccgagtattgctcttattgcagaatcacatttcattctgaacagaaaactggatgaggcgataagagtagcgggaagtatcgaaatgacaagaattcgagtcagcatactggaagatgatgtaaagaagctgaaaagagcagtaaatatgtgatctatatcataagatacgagaaattagtagattatgaagagaatatcagttatacaacagagcttactataattagaaaagaaaacagtaaataaatgaatgcagcttactttggcaaatgtgccgaaataggctgcatttttgattataagcttctatttttaatttggatcttaaaggcataaaataaagaccagcaatatacaataacaaaagatttctaaataaatcagatacaaatcataaataataaaatgttattatgtgttaacatttactgatatataaataaaagtgatggaatatagatcgaatgtgttaacagcatttcctataatttcatagatacaaaccaagagtaagtaagacagcttgacaggccccatattaacatataaagtataagaaacatatcgtttcaaaatcaggtgagacggccaaataaatccaagtcgaacggcagaaggagctctacatgaaaaagctaagaagtcccttgttatcggtgctcgcaatttacatactgtgttttatctttcgaatgatagaatattttatgattcgtacagatcagaccttattgggagaagcgattatacataagattgcgggcatcataattctctggattgcaataaaaatgctatctactgatttcgagtttattggatttaaacgtaaaggtatattcaaaaattttgcattcggtttactgtttggtatttctgtgtttgcggccgcatatggggcagaaatcctgattgcagtttcgcaggggaatttccagtcccttcaattttatgtcagcagctatgctgtggataaaaatataggaaatcagaccggtatcctgttcttccttatttgtattgttggtaacatcgttaatgtactgatggaggaaggcgtctatcgagggctttttcaaaaaattcttcaacagaaatacaaatttattgcagcagcaattatttgctccattttatttggtgcgtggcacgacataggcccgattcgcagttattatgacggtatgagcagcatgggagggatggtggctaacattttcatgttggtaatcacaagcggtcttgttggttttaaagcggctatgataacgaaattaaccggctcactttatatggctatgggggatcattttgtcaataatacaatcgtaaatattttacacgttacctcctatacaggcgctgatgaattgatgtttgtgcgaatcacaattgctcaaagtctctcattcctgttggtccttattttctatatctggaaacagaagaagattagttcaggcagcgctccctccggaaattagtcagccgtatcaaatcaggaatggcatcattaaacgataaattttgattgcgggcagtgcatttgtctacatacttatgcattgcccgcttgatgattatgcgcatttggacaggaagaatttatcctgtctttttcctggcttttatgagctgaatatagtttttcttatataggaaacaaatattgtggaaacatgtttaaagcgtggcagatagaaacgtaaacgtgggtgaaatacagggagtctggcattagcatagaaaatataaagccgcacaaaaaatatgatcataaatgacatacagcttaaaataaaagcaaaaggctgaacaaaggaaatataaagtatttctcacaaactcccaaataatgtaaatttataagccgcgatgaatatattaaatacgctggaaattatgtctttcacacacggaaaacagattgaaattgtccgttgacaagtgacgcaaaatttgttaaactatgtaactaacaagcaaaaatatattagttacattaataaaaaggacaagaaagagaggaaaatttaatgggtacaattattggcgacggcattacttttgacgacgtacttttagttccagcttattcagaagtaatccccaatcaggttgatttgacgacctgcctcacgaaaaccatcaagctgaacattcccctgatgagtgctggtatggatacggttaccgagcaccgtatggcaattgccatggcaagacagggaggtatcggtattatccacaagaacatgtcgattcaggcgcaggcagatgaggttgataaggtaaagaggtcggagaatggcgtcattacggatccattttatctttccccagaacatacattaaaggatgcggacgagctgatggcgaagttccgtatttccggtgtgccgattacagaaggcaaaaagctggttggtatcattaccaaccgtgatttaaaatttgaggaagatttttcccgcaaaattaaagagtgtatgacttccaaaaacctggtgacggcgaaggaaggcattactatgacagaagcgaagaagattcttgccaaggcgagagtggaaaagcttccgattgttgatgatgattttaatttaaagggactcattacaattaaggatattgaaaagcagatcaaatatccgttatcagcaaaagacagccagggaagacttctgtgtggtgctgccatcggaattactgctaatgttctggatcgtgtggccgctttggtcgcttccaaggtcgatgtgattgtcctggattccgctcatggccattctgccaacgttttaaactgtgtacgcatgattaaggaagcatacccggatcttccggttatcgctggaaacatagcgaccggagacgcggcaaaggccctgattgaagccggtgcagatgcgattaaggtcggtattggacctggttctatctgtacaacccgtgtggttgctggtatcggtgtgccgcagattacagcagttatggattgctatgcggtagcaaaagaatatggaattccagttattgcagatggtggtatcaagtattccggagatttaacaaaggccatcgcagcgggcggtaatgtctgcatgatgggaagtatgtttgccggatgcgatgagagcccgggaacatttgagctgtatcagggaagaaagtataaggtatatcgtggcatgggttctattgcagccatggaaaacggaagcaaggaccgttacttccagtctgatgccaaaaaactggttccggaaggcgtggaaggccgtgttgcatacaaaggtctcgtcgaagataccgtattccagatgctgggcggactcagagcaggaatgggctattgtggtgcttctgatattaagacacttcaggaaacagctaaatttgtaaagattaccgcagcatccctgaaggaaagccacccgcatgatattcatattacgaaagaggctccgaactacagtattgatgagtaggatcggttgtgacggaattgtggcatttctataaatagtataattataataggaagagactctgttttgagaaaagcagaggctcttttcatttgaagggcaggaatatattagagaagtttttaatatagttcatccaaatgttcgtttttatggatatagggtgatgaaggatcagccggataaattagtccttaatgggcaggaaaaggctgggcagaccgtctattatgaatattaaattgatttagtgactacaagtaaattttattgtaacaatgtaaaagaataccgtgaaacacttagaccctttcatgcagtctatggcgtgcagagattaccgtgctgagcagcaagaagagggaagaagagaaataaagttttacaataaaaatgattaaaaaggcgaaggcctggcagaagtaataatctgtcaggtcttcgccttttcatgtcgaaaatctttttaaaaggtcaaatattctataaaaataaatagatttctataatttaacgctataactaagtctctgatttcctccatcttaagtatttcgttatagtttcttttaggcaaagttatatctgcctaaattttttcgtgaagttaatttatgaccttattttcgcttatgtaacaaaaaatcatgaaaattacgataaataacacaaaatagggcgcagtaaacagtaaaaaaattaaaatataggggttaaatagaagatacagattaaaaataaagacaatattgtatagactaaagtctacttgtatgatatgaatactaaaaaaatagaggaaagtaaaaaatagtacatataatttattttattatacagttatttggattttttaaatttgttttatttctatatcttacgaaaacattaattataagagcattatacagtgccatggtcacaaaacggttacatttcaagatttttccataatttatttttgtttttttgcttttttttatgccaggttggctgttttaaaactcataaaataaattataggaaggtgaataaattgtcgatagcaaaaatgagcatgattcataattcatatcgttattttaccatttctgtagataaatatgaagatcgatgtatgaagggagttatctatcatgcgggaaaaactccgggaatccgatatgatagtttccttgaaatgataattcaaatgaatcgtatttttgacagcatgtcatgtcctaaacaggctatggaactgaggcgatttacaggaatagagtatccggaaccggtaatacgggaatgcaaccggtatcagaatggcagactggcgacgtttcagatttatgtgaaatttcgctataacgccagttggcagggagatattacctggctggaaggagaacagacagaaagctttgaaagtcttttgcagatgcttcagatgattgatcgaatcttcaccggtcaatcggaggagagaggaacgagggtcacaaaaatctgccagattgcgattaattcctgcgaaaagggattggtgacaggaagagtacaaaacgcttttatcaatcatctggagcgatttaaaggaaccattggtctggcagatgctatggtacgtctgtttgaagcaggcgttggagaaaatgattccggaaaatctctggaaggaaaaattatttcagaggaaacctgggattcctatcgtttaggcgggaaggaagcgaccttcctgatcaagatcctgttcagggaacactcaacctggcagggagtaatttactggcgtgaaaccggtgagaaacaggctttcagaagctttttggagatgatcatgttgatagcttcagcattagaaagcggtaaggaagagagtgagtttgaagatagatttacaacaactaataatagagaaaaagcccggatggaagggtaaggaaggagagaaagtatgaaaggacttagaaaaaagttcagacgagggcttgccgcgttcctggcatttgttctgaccatgacctccgtgaacacggtgtcattggcagatgtatcaaatgcactggaaacagaaaaagctacctttgtcatgagcggagaagatatagtggaatccgctcaggctgctattgataatggcagtacctttacttacgaggatctcggaatcgaggagacaggaagtaccgcgaaagagtatcagaagctatttacaaatggcacggtatatgaaatcgccccttcttatgacctggacgaagaggaaaacgcagacggagcgaatctccggatgtttatccgagtaaaaggtgaaacagaaggatatcagataactggtgaggaagaaattattttcctttatatcaatgactctgaatccaaaattgcatttcgttccagaattgatgattatgtaacggataaggttacggttaaaggaaattcttctttggcagaaaccgaaaagccggtactcgatgagaatggaaatgcaatagaaggcgataagccggcacaaaccccggaagaatccactgtacccagtggggaaaccggaagtgtagaagagacgaaggagccggagactgaggcaccggcacaggtaccggaagaatcgatgcaggaaccggagtcggaggtacctacgcaggaaccggaaacaacagcaccggcagaagagccaaagacagaggctcctacgcaggcagaaaccgaaaaaccaacacaggccccggtacaggaaccggaaacacaggccccagtgcaggagccagagacacaggcaccggaaactgatgcggcaacacaggcaccggaagtgcaggaaccagatacagaagctcccgcacaggaaccggaaccagaagcaccggcacaggaaccagaggcggcagatacaggaaatgaaaccgcatctataataagaaacaacacctacgtattgacaactgcaattgagccgacttcagaagaatcagacgtatcaattgtagatgaagaggttccgaaagcagatagcccgaaagaggatacagaagcaaatacgcctgccgataatccggtttcagtaagcacaggaagtaatgcggataaaggtgatcatgccgatcatgaagagaataaaccttcagagaaaatcgaaggcaagacctatggccatgtattactcaatgaagaaagttatgcaaaagcatatgtaacgacccttgataaaatggggatatctgttgaagcagcagaaggattaactcttgcgattcatcataatgcattttataatgataaagatatatcagaggatgaagtgattagaggtctgaaggaaggggacgtgattaatccagcggattatgcctgggataaagattttcttacctatgcggggagcagtcaggataatattgttataagcagtcagactgagaacagagtagatttatattataatgcaatagctgaagaaaaaacagaagatgaggtgacaattacaggcgcaatccccagaagctattttcgatcggcaaaagcagatgataatactacacctggtaaggtatttccaacgaaaacagcagagtgggtagatgaagcgaatggaattggcaagattgattttacgatatatggaaacccaattagacgaggcagtgatgttgttttagttattgacagttccggcagtatggagggagaaaaatggtcaacagctaagaaagcagctaaagggtttatagataatttatatcagaataaagatggggttgtatctgacgatagaattgctattgttgattttgacagctcggcaaaggcttatcctggtacaaataatggatcagagacttttttaaaggttgatgacaaaattacggtaaacaaaaacaattattcagcaacaaattattttaaatcatatgttctggattcccaaatgaaagataaaggcggaacagactatgataaagcattacaaacagctcagagcgtaattaataatcgtaaggatagctccagaccagcatatatagtatttatgagtgatggagagcctaatgggtataactactggtttgagtattattattatgatggacaggatgaggcagaagcactaaagaatgatggtgttactatctattctcttggattaaatattggttcaacaaattttaataaattcattgttccattagcctccgatcctgcatcaacatatgctaaaaatatagttaatacaagcgatctggtaggcatctacgacgccatcgccagctccatcaaaatcgccggaacagaagcgacaattacagatgtcataaacacagaagcgtttgagattgcaacggattacaacgatggcatatggtatgaagcaagcacaggcaccgtaagcaagagttccgataataagacagttacatgggatttcggtaatatttccgccaataaggaaacccttactatctatattaaagtaaaggatacggtaccaggcggcactgcaccggataccaacaaagaagcaaaagtagattacacggatccgaacgaacagtcacagactcaggatataccgagccccaacctggcagttggagatgtgggtaccatcacattaaactattacctggttaatgaagacggcattacaatcaacggaaccggcgaagcgattgattttgcgcgccgccagcagctgggaaccaaactttacggggatgcacctcaggagtttggcagctataccgtgaatgcaccatcgaccattgagtacaatggtatcaaatatcagtatgtagcggcaagtgcatcaaaggatggaagtgcgaatcctgcaaatgtagagctgagccctgccaagaaggctgttaatctgtactatggctatcaggaaatcaaagatgtcacagtaacctttcacggcaatggaggcacaccaagcgttagcagcgtgaccgtgccaaaggataccgctttaggcggccagatagcaaccgcagtaagagaggatcacaatttccttggctggaatacagcaatggatggctctggcagcgcgttcacttccaacacgatcgttacagataacattactgtatacgcacagtggcagaaaaaacaggcgctgaccatcaaagcagccgatacagaaaaagtctataatggtgaaatgcagtatgcatcggaaacaggatacgaatcgactggtttaaaagcaggtcacagaattactaacataaaagccagtggttccggacgtgatgttaaggaagatggctatccaatcaccattacaggtagtgtaaaagttgtaaatgaatcgggtgtagatgtaacacatgaatacacgattacaaaagaaccgggaactttgacaattaaaccaaaagaagtgacaattacggtagataacagttcaaaggcctatggttccccggacccgaagttcaccggtaaagtagaaggccttgtaaacgaaacagaccttggcaccgtatcatttgtgagaataaatgaggctgaggaagtcggtgtttacgagaaggtactcgctgcaaagtataaagcaaataaaaactatactgttacagagcacagaggcgactttgaaatcaaggtagctacgatgccgggagcgtctttatcggctaagggtggcagctgggaatacgatggaaatgcacattacgcagcagcaactcttaataaggcggatggctataccgtatattacaaagtaaatgacggtgactggacagtaaacccgccgagtgtaacagaggtatcagaaggtattgtaacggtatctgtaaaagcaacgaaatatggctatgtagacctggagactgagaatgtcacgctgcagataacaccgaagccagtgacaattacagtgaaaaatgcagaaaagacctttggggaaagcgatccaacctttgagggaaccgtacagggacttgttaatagtacagatcttggaacggttacttataaacgatcgaatgataccgagagcgtaggaacgtatattggagttctgattccagaatacaaagaaaacaccaattataagataactgtaaaaccaggtgatttcaaaattaatccggcaaaggatcctgaggcggacttaaagattgccgggggcagctggccgtatgacggaaaagagcataaagtaaagctgaatgtcatagattctgcactggctgcactgaagagatatacgatcgaatacagtacggacggaggccagacctggtctaaaactgtaccgggagtgaccaatgtatccgacggaacgcttaccgttattgcaagaggtactcgcgaaggatatgaaacgctgaaatcgaatgaagttacgatttcaattacgccggcgccggtaacgattgttgttgacaatgcagaaaagttctataatgacccggatccggcatttacaggaaagataaacggacttgtaaaagcgggagatcttggaaacgtaacctacagcagaaccaatgccgatgaagaagtaggcgtatatcagaacgtattaactgcaaacttttatataaataacaactatacagtaaagatagaaaatggcgattttgaaattaagagcgcatcactcgaaggcgcagtgctgacagcggttggcggagagtggacttatgatggaaatgcacatgccgccacagctgcattggaaaatgcacccggctatacaatctattataagaccggaaacggcgactggactacagaagcaccgagtgtgacaaacgtagcagatgggcttgtaacagtatcggttaaagcagaacgccatggatacgaagccctggaggcagaagatgtaacgctcaaaatactgccgaaggaagttatcatccaggtaaagaatgcagagaagttctttgatgagccggatccaaaattcgaaggaaccgtgtcagcgttagtaaaccaggaagaccttggtacggtaacgtacaccagagaaaatacggaagaagcagttggtatatacaacgaagtactgacagcaaactatacttcaaatggtaactatgaagtgaccattaaaaagggcgattttgaaatcaagacagcgactttggaaggtgcttctctaagcgcagccggcggaagctggacgtatgatggaaaaacgcattacgccaacgcagaacttacaaatgcggataactataccatctattatcgtgtaggagatggtgaatggacgacggaaataccaggtgtcaccaatgtatcagaaggcgaattgacagtatctgtgaaagcagcgagaaccggctacgtggatcttgtgacagaagatgtcaaactcgtcattacaccaagagacgcgactatcactgtaaatgatgcagaaaaattctacgacgaaaaagatccgtcatttacaggaacagagactaatctggtaaaggcgggagatctgggaacggttacttaccgcagaaccaacgatgacgaggaagtaggaacctatgaagaggtattgacggcagattataccgccaacgacaactataaagtaaccgtagtaaatgcagattttacgattaaaactgcttctatcgcaggtgcgaaattaaccgcggccggcggaagctggatctacgatggcgaggcccatgcggcagccggaagagttgagaacgcagacggctacactgtatactataaagtcggagacggcgagtggaccacagaggtcccgagtgtaaccaatgtactggacggaattgtgacagtatccgtaaaggcaacaagaacgggttatgaagaactgacgactgacgcggttgctctggagatcattccgaaagatgcagccattgttgtagacgatgcagagaagttttatgatgaagcagatccgaagtttacaggaaccgtgacaggacttgtaaaggaaggcgatttaacagggctgacctacatcagaacaaacgatgacgaggcagtcggcatttatccggaagtactggcagcagcctatatagaaaatccgaactacaatgtaaccgagcacaagggaacgtttgaaatcaagacagcgaccatgaaggatgccaaagtgacggcagacggcggaagctgggtatacgatggagcggcacatgcggcgaccgcatctcttaagaacgcagacggctatactgtatattacaaggctggagacggcgaatggaccacgacagcaccgagcgttaccaacgtggcagaaggaatcgtaaccgtatccgtcaaggcaacgaagacgggatatacagatttaacggctgaagacgtaaccattcagatcacaaagaagccggcaacgatcacggtaaacaatgcggagaagttctttaacgaggcagacccggcatttaccggaaccgtaacaaaactggtagcagacggcgatctcggaacgataacctatgtgagaaccaatgacgcagcaggtgtgggaacgtatgagaaggtgctggatgcagtttacacagacaacacaaactacgaagtaaccgtaaaacgcggcgactttaagattaaagaagcgaaggacccggaggcagagcttaagattgtcggaggaagctgggtatatgacggagatgagcacagagtaaaactggatgtcatcgattccgttctggcagcactgaagaagtataagatcgaatacagtacggacggaggaaatacctggtctgagactgtaccgggagtcaccaatgtggcagatggaaccgtaactgtgattgcaagaggtacccgtgaaggttatgagaccctggtatccaatgagacaacaatccagatcacagccagaaccgcaacgatccgggtacatgacgcggagaagttcttcgatgaatctgacccggcatttacgggaacagaagagaacctggtaaaagcaggggatctcggaaccgtaacctacagaagaacaaacgcagacgaagcggtaggaacctatccggaagtactgactgcggactacacggcaaacggcaactatattgtaaatgtagtaaatggagacttcgaaatcaagaccgcatccataaaagatgcaaagctggaagcagccggcggaagctggatctatgacggagcagcccacgcggcctccggaaatgtaacgaacgcagacggctacacagtatactacaaagcaggcaatggcgagtggaccacagaggccccgagcgtcaccaatgtactggaaggaactgtaaccgtatccgtgaaggctgtgagaagcggctatgcagatttaacgacagaggatgtaacccttaagattaccccaagggaagcagtcatcacagtggatcatgcggagaagtattttgatgagcaggatccggaatttactggaaaggcagcaaaccttgtggcgtccggagatctgggaaccattacctacagaagaaccaacacagaagaggcagtaggaacctatccgaaggtactgacagcagattatgagtcaaacagcaactacattgtaaccgtagtgaagggagactttgctattaagaccgctttcattgaggacgcggaactggcagcagccggtggaagctggacctatgacggagccgcccacgaggcagccgctaggcttgagcatgcacctggttacacgatttattataaggctggaaacggtgaatggagtaccgaagcaccaagcgttaccaatgtagcagatggaaccgtaacggtatctgtgaaggcgacgaaaaccggttatgaggacttaacggctgaagatgtaacgattcgcataacagcaaggccggcaaccattgttgtagataacaaatcgaaatcttatagtgacattgacccattatttacgggtcagatacagggattgatatccgacggagatttagggactgtagtttaccacagacttgacgcggataagaacaaagaggcggttggcgctgacattacactgactgcaagctacagtgataattccaactataaggtagaggtgaagaacggtaagctgaatatcattgcattaaatacgaataccgttaatgtaaccggagaaaccgtaacgtatgatggaaagacacatggactgagagaagtaaccgcactgaaggaaggctccacgattctttactccgtggataatcagaactttagtgagacagtgcctgtctttacagaagcgggcagccacaccgtctatgtaaaggctgtcaatccgaattatcacgacacagccgttgtaacaggtattgtagtcattcagaaacgtgcattatccattacagcagccagtgcggaaagaaaatacaacggaacagaattaaccgcaccgaccgcatcgatcacagacggaacgcttgcagacggccagacactgacggcagttaaagtgacaggttcacagacctcagttggcagcagcgagaatatagccagtgatgcagtgatcatggcagataatggagaagttacctccaactataatatcacgtatttagcaggcactcttagagtaacctcaggcagcagcggaggcggtggaggcggaggcggcaatactccgaatcctgataagccatacgtgccggaggggcctggaactgattcgggaacagtaacgattgaaccaggtgaggtaccgttggcaaacttacctgaaagcagttcggctgataacttagtgctgattgatgacggcaatgtaccgcttgcaggtcttccgaagaccggtgatcgtgcaggtgcacacgcaggattagcagcactgctgtccggattcctgctggcagcatttacagcgctgagcagcaagaagagggaagaagagaagtaaagatttcgatacgaaatgtgtgattatgcaaatggcggcggcctggcagatgttatgatctgccaggccgccgccgtttgtaggaattaaatgccgagcttcttattttcccgtcagaagctccacctgcgctactacctgtccgatgtacacgctcagcggcagctcctcacagccaaccacgtagtgattgcatttgttcaccggaatcaggattttcttagcctgactggagccgatggcttccgccatgaccggagtgatctcaccgagcagggagttcgggattacgataccgatgggtccgataataatatctgcgctgcggctggccacgaccacgggattttcaccggttgcaccggcgtccgcaccggctttcagcatggaggaggtggcgatggagttggttccgattgcggttatttcaagttccggatgggacttttttaactggacaataacggcgtgtcccatcttgccgccctgcccgtcgattacgataattttcatttgtaggttccttttcaatgatatatgattttcttatttattataaaacattcctgccgtgtttacaagaaaagggtatgaattttgaagtggctcccttttccctgtttacggaaggggttactttgtagtataatatggaattataaagccaataaaaattaccggaatcgcagatccggcagtctgataaccaataataatgtaaatagaccaacaattacaaaaaacaggaggaatacatcatgtatgtagaaaacaaaaatgttccgcttacagacttaggcggcggtgttgtgcggaaggtattggcctacagcgaaaatttaatgaatgtggagctgaagtttgtaaagggagcgatcggtgcaaaacacagccatcctcatgagcagatcggctatatcatatccggttccctgttatttcaggaggaaggcaaggaagacaaagttctggtaacaggagacagctattacgttgagccggatgtggtgcacggtgtggtagcgctggaagagaccatgctgctggatatctttacaccaatgagaaaagatttcgtggaataaagaaccataacaaggaagaagtccgggaaacagtttcatttcccggacttcttccttatttttccttatgaggcagtctgccgcgtaagaagcgtttctttaatttactccagttaaacggtattaccggatagatatagctcttgcctgcgatcgtcttgttaaatacgacagcacagacggatagtatgactccgatggcaaatccccagtaattaaagagggcggtgagcaccagcaggatcattcgcatgaatttgaatgcgtagcccagctcaaagctggcctgggagtaattggcaatggtcacgaaggccatatagagcatggtttcactgttaaaccagccggattttacggagtattcacccaggacgataccggcgataacactgagcggtgtggtcagcatgctgggcgtattgacagcggccaacctcagaccatcgatggcaaattccagtatgagaagctggaagatgagcggtacatgaggcggttctgacaattgaatgaactccagccaggaagggatgacattgggattctgcatcagcagaagccacagcggcgttaaataaagcgtcagcacggagatcgccatacgcgaaagccgcaggtatgatcccgttaccggcgggaaatagtaatcgtcggcttcttcaataatatcgaagacagacgatggcaggatcatggcggcaggagagttatctaccagaatgatgatatttccctccaggatggaggcggccgcagtgtcgggacgctcggaaaatttaaacttgggaaatggattgtaccatttatgtggataaaggcactccgcaaggctttcctggttcatggtcaaagcgtcgacctccagcttgttgattctgtctttgatcatggcgaggagattttcatcgatccggccctgcatgtagcagagggcgatgtccgtgtgggagctttccccggcgctggtgatctccatggtgagctttggatcacggattcggcggcggatcagggccgtgttgaaaataagtgtttccacaaacccgtcacgggaaccacgaagtaccttgtctttttctggctcagacacaccacgggccggataggtgcggcagtcgatggtgaagcagctgtcatacccgtctatgaacagacacgacacgcccatgaggagctggccgatcatctcggaatcactctttaccagtccaacctctccgtagggaaggtatttcttggaaaatgcgtgagcgtcttctggcatggagtcttccttcagcgtcgaaaatgcctggagtattttgagccatacctcatctttggtgaagccatctataaaatagagacaggcctcccgcccacccacatggatgactcggtagactacgtcgaaattcgtgtccacattcaatttttcttttagataagacatgttatcagaaagcttactggaaaagtccatattatggtctccttttttactgttttggtagtccgcggtttatgcggcaatgaaagggaattagcgatatagaaagtatgcgcatttttgatgaaaatatgtttcatgaaaacatgtacgtatgacaaagacgtttttgcatacattgtagaaaaaattgcgataatgattcttccagcccggcccttttttggtgaaatacactaaaatgattgactttttccattattgatgttatgattgtccatgtgagaagcacaaaggggtgccttgcgtgtatgatttcaggcatggggatgccaaaattataagaacttaataatgtgacggttttagatcgtgacgaagaactgctttctgtgggggataagcagttctttttttgtagtagaaaagtactcctattacataaaaagccctctgggcaggaggcgcactgtgcaccaagaaaatatggctgctgaagcgaccgcgctccggcgcgcgagctcggcttgccggtctcttttttggtccctggaaagtttgtgatcagggaatcacagcaagtaaaatcaagcatgaattgctccgtggctttataataacggtagggtggttgaaacaaggagaacagacgaatgtacgagtggcagaaacagattcaaatctttgtcgatgaaattgacaaatgcatcaaaaattataacgatgaagctttgacactgagctttctttcccgcagtctcggttattccgaattttatacgacgagaaaatttaaagagatatcgggtatgcagtttcgggattacttaaggctgaggaaattagcctttgcactaaaagaggtccgggacagtgataaaagctttttggatattgcactggattatggcttttcgtcaaatgaagcctttaccagggcctttaaagggacttatggcatgacgcccagtgaataccgcaaaaacccgaagccagttgttctgcgtacaaaaataaaccctttcgaccgctacttattaggattaggagaaattggcatgatgaaatctaccgatggtattaaaatttattttgtaaccatacccgcacacaaatttctgcacattaaaaattatgagagtaatgggtactgggatttctggcagaaacagaatcagattccgggccaggattacgaaaccatttgcggtttactcgacagcattaaggggaaattagacgatgagggcggaagcgaacctaactgtggaagcggccagatcatggcctatattaacgacccggaaggcagactctgcgactggggaatcccgcgcaccgagtgtcacggcgtacggctcccttatgattataaaggtgagataccgccgcagatgctgttcattgatgtccccgaagccgagtatgtcgtctttgaacacggccccttcgattatgaacaggaaaaccgcagtgttgaggaaaagattgaagcggcaatggctgcctttgattattccggcaccggctacagctttgataccacaccgggcagaatcacatacttttacttcaatccggaacagtattttaagtatatcagaccggtgaaaaggtagaggaatgtctacatcagagcggcaaaccgtatcccatcatacgtaaacgaattcccataagcaaaaagatcgggattttcaaaaatgaactgtacgaagaaaataatattctgttcaggattctctggctttttgaaataggtttcattgtcgattaaaacgataatcgtaaaatcttccagatgaacgtgtgtaacccggtaatcgtcggaatcaagataatcctgcatctgttcaaatttttctttgggcagtttcgtctcatgctgaatcttcgtgacgaccatcttaaatttttccataggtacctcctcattgtgcctgcagtgaagttcgcagagcctaatggcagtgtgccttcagaaattgaaaaaaaccgccggaacctaatcgattaaggattcccggcggtttcgccatggagacaacagggctcgaacctgcgaccttctacacgtcaagcagatgctctcccagctgagctatatctccatatcgctattttaatcgaaaggagcaaaaaaatcaatagttagaataaaattttttaagttgtcttaatttgtattgatggaagtgagaattttacatataatagcattaatgcgtacttaaggagaggagttttttactatgtggaggaagttaagaaagaacaggcgttttcggatatttatgacgacagtggcggtcatcggttcggcgctgcttcagacatttgttattcaggcgtttataaggccggctgggctgctgtccggcggatttaccggaatagcgatcctgattgaccgcgtgacgtccctgttcggaatcaatctgtcaacttctctggccatggtgattttgaatattccggtggcctgggcctgcagcaagagtatcagccggcggtttacatttttctcactgctccaggtatttctggccagtttatttttgaaaatatttcacttctcaccgatcttcgaggacgtgatcctgaatgtgatctacggaggcgtgctgtatggtttctgcatcgtcctggcgctgagaggcaatgcctccacaggcggaacggactttatcgccctctacgtatccaataagacgggaaattccatctggacgtctgtatttgtgggaaatgtggtgcttttatgtatcttcggagctatcttcggatgggattatgcgggatattcgattctgtttcagtttgtgtccacgatgatcgtatccaccttccatcaccgctatgagcgggtgacactgcagataacgacctccaaaggcctggagatgacggacgcctatgtaaagatcttccggcacggcatatcctgtgtggatgccatgggcggatacagtaaaaaacacatgtacctgcttcacaccgtggtgtcttcctacgaggtggcggatatcatcaccctgcttcatgaggtggatgagcatgtgatcgtcaatatgttcaggacccagcagttctacggcagcttttaccgtgctcccatggagtaggcggagcctaacggttccgcctgcgaaacccataccagtggtgtttcttcagcttggaaaaccagttaaaatagaagaagaacaggattgaagtgatgacccatgtcagcggatagctgaaaataacggtctgaatcgtcggacgaagcggtactgcagcccagatccagacgacacggagtgcacagacgcccagacaggtgataatcatgggaatccagcagtcgccgacgcctcgcagagaaccggaataaatctcgatgcagacgtaggtgaagaaggtcggaaccagatactgcaagatctcggttcctttttcgataaccgccgcgtccgtggtaaacagcagatagatatagctgccgccgcagtagagcaggacgcttaacaggaaggtggcggcaaagctcatggccagacacacgcggacgcccttgtgaaccctgtcctttttcccggcgccgtagttctgtccaacgaatgtggtaacggagatgccgaaggcgttgatgatcatccagaacacgctgtcgatctttccgtatgcggtccaggcagcaatggtatcggttccgagcgcattgacgctggactggataatcacgttggaggcggagtacatgacggactgaagacccgcggggaatccgatctggataatccgcttcagcatgtccagatccagccgaatagaccgggggatcagatggtacgactcctttgtcttcatcagcacgatgatgaccagtacggcgctgaccagctgggagatgatggtagccagcgcggctcccatgacgcccatatgcaggtagacgacgaaaacgatatccagtacaatgttggtaaaacagctggcaatcaggaagtacagcggccgtttcgagtccccgatcgcccgcaggataccggctcccatgttatagatcaggttgccgatgactcccagaaaatagattcgcatatacaaaaccgcgtgatttaatatatcatccggtgttcccatggcggataaggcccacggcgcgcctgccacaccgatgaccatgaggacaatgcctcccacgatggaaaatgcaatcgacgtatgtaccgccctgctcacccggtccggctgtttcgcaccgtaaaactgggagataattacggtggcaccggaagaaagtcctacgaagaaccccacaagaagattgatcagggttcccgtaggacctcctacggctgccagcgcttcctttccaacgaaccgccctacaatcacggcatcggcggtgttatagagctgctggaaaaatgttccaaataaaattggaaagaaaaacagaagaagctgtttccagatcactccttctgtaatttgattctgccccatgacactctgtgtcctgcttttctgactcatatcccgttcctcttactgtaaaataattatgtattctgatctcattatacagggagaaaagagaaaacacaatccccataccatattcttattttgcaatttcggctttggtcagcgccgtgtcgactgcttttaagaggacggtggatgtgtagcgtgtctcatcggagtaggagatgtttttggtggactgattttttacaatctgctccgagagagtgtccatggccggctgcatcagcggatacatggtggtgaccgcttcgcttaagggaacgagggtgaccgatgtaattttatccgcatccacggttacctgtacgttgacatcctggttattcagcgtgatcgcggaagagtaaactccgggcacataggtggccacttctccggaagtgggaacggtatcttttttcggccggaacatgatgagaaacagggtgattaacagtattccgaggccgacaaagatggcggtgtagatgatttctttcatccgcagtactacaatttttgttttagagctcatattaaaataaggtcctccgaacgggttttgatatagtgtattctgcttgagggcggtttatgaatagacggcaggagcacctgcatttaaaaagagaaagggccgtatttcgtttgcagggagaactgttgttctgaaaacaatggacttgtacataaaaatatagtaaaatatagttagatagccattaaaatgtgaagggcttgagagggaaggagcaacacgaaagatatgtccatacagttattaacaggcggttccggttccggaaagacacaccgcctgtataccgatttaatcagggattccattgagaatccggacacgaagtattttgccattgtcccggagcagtttaccatgcagacacagaaggagattgtgacgctgcatccgaaccacggcgtgatgaatattgatattgtcagcttccagcgtctggcgtaccgagttttcgaggagcttgccatcgtaaacccggacgtcctggacgatatgggaaaatccatgattctgagaaaggtgacaggaggtaaacagaaggaactgccgctgtaccagtcccatctgaatcagaacggctttatcggccagttaaaatccatgctttcagagctttaccagtacggcattacgccggaaatgctggaagcgaagatcccggagaccaccagccccatgctccgccagaagctggaggatatttccgtcatttataaggcgtttaaggagtatatcaaggaccgctatatcacgacggaggagattctggatgtgctttgtaagcacctgccggaatcgaggctgatcaaagacagtgtgatcactctggacggctacacgggctttactccggtccagtaccgcctgctggacctttttctccgttacagccgccgggtgatcgtgactgtgaccatcgatccatccgtggcggagcgggggaagaggggcgtgcaggacttatttcacatgagcagcgagatgatggataagttaaacgcactggcccgccagaatcacgtaaagcgggaaccggatatcgttctcgacgaccatccggctgtccggtaccgcagcggagtagagcagcagatggagcagccggcagcagacacgccgtcccattcggcgcttgattttctggagcagaacttataccgctacagcggccgtgtgtattccggcaaagcggaggagatccgtctggtgcaggcggtgaatccggccggggagatctcccacgtggtccggcagatcggaaaactgctgcgcgagggatatcggtaccgtgacatggccgttatcaccggtgacatcggaagctttgcaggagagctgatccatcagtttgatgcgtcggagattccgtacttcctggatgacaaaaagagcatcctgaaaaatcccatggtcgagctggtgcgcgcggcgctggagacgattcagaaggatttttcctacgaaaccgtgttccgctacttaagaaccggtcttgtgacgaagccggaggatgagcgcaggctggaccgcctggagaactacgtgatcgccatgggaatccgtggattaaaacggtggaataccacctgggaaggctggtaccgcggcggcagggacttaaatttagaggagttaaaccagctccgggaagagattatggcgcctctcacggcatttatcgaggcgttccgggaagaaggaaggacggtgcgcaccatgacggaggccgtggtccggcttctggaggcgctttcggtggaggagaagatgctggccagagaggcctcatttcgggaacagggagaatttgggcttgccaaagaatacggtcaggtgtacggcctcgtcgtcgatctgatggaccgtctcgccaggctcttaggggacgagaaggtgagccgcagggagtacgcggagattctggacgcgggcttttccgaaatcaaggtaggcctgatcccggcggccgtggaccggatcgtggtgggcgatattacgagaacgcgtctcgaccatatcaagattctgttttttatcggtgtaaacgatggaatcgtgccgcagaagaaggaaaacagcagcctgtttacggataaggaacgggaatttttaggcagccatcacattgagctggcgcccaccgtacgtgtggagagcttccgtcagcggttctatctgtatctcgctttaacgaagccggcggaacggctttatctctccttctcggccatggatgcgtcgggaaagagcctgcggccatcgatattgctgggagagttaagaaagctgtttccgcagctgaccgttgtggccgcatcggatgaagcggccggcgtgccgctctccatccgggaagccaggggacggttgacccacggccttcggaacttcgagatgacccgggaggattcggaattcttggagctgttccgccattttatgatggatgaggagcagagagagaacgtaaaaagactggtagatgcggcattttacgcctatgaggagcgtggaatcgggaaaatggcggcgaaggcgctgtacggcacggtgctgggcggcagtgtcacgaggctggaacagtacgcgtcctgtgcctatgcccatttcctgaattacggtctggagctggcagagcgtcagcagtatgagctggctgctatggacatcggtaatctgtttcacgattccatcgacctctgttttaaaaagatgaaggaacagggaggcgactggaagacgatcggggaagacgagagaaaggctctggtgcataccgccgtgaccgaggtgactgaggaatatgggaatacgatcttaaagagctccgccagaaatgcctggctggcccgcaaggtggagaagatcacggaccgtaccatatgggcgctggcggagcagctgaagaaaggcgatttcacgccggtaggattcgaggtgtccttctcggccgccgataatctgaaggccatgaaaatcgctctctccgaggaggaggcgcttcatttgaggggccgtatcgaccgtatggacttgtgcgaggatgaggaacacgtctatgtgaagatcatcgattataaatccggcgggacttccttcgatctgactgcgctttattacggtctgcagctgcagctggtggtctatatggacgcggccatggagatggaggaacgccgcaatccggacaaggctgtgatcccggccggtattttctattataatatcaacgacccggtgatcgaccgggaaggagacatgaccccggaggccatcgacaggcggattctaaaggaactgcgcatgaacggtctggtaaacagcgagctggaggtcatcagccatctggaccacgagattgagacggaatccgatgtcatcccggtggcgatgaagaacggcctgatccaggaggcgaagtcatccgtagcgggaggaaaccggttctcggccttaaaacgctatgtcaatgagaagctgaagaccgagggacgcgagattctggaaggagccgtggcggtgaacccgtacaagcagggaaataagacggcctgcgactactgcccgtaccatgcggtgtgcggcttcgatttaaaaacctccgggtttggcttccgcaaattcaaaccactgaaatcagaagaaatatggccggagatagaaggagagcagcaggatggcgattaactggacaaaagaacagaaggcggtcattgaaagcagaaaccgcaatcttctcgtttctgcggcagcgggcagcggaaagacagcggttctggtggagcggattatccgcatgatcacagagggagagaatcccctggacatcgatcagcttctggttatgacatttacgaaggcggcggcggatgagatgcgggagcgcgtacttctggccgtcgatgaaaaattgaaggaggaccctgaaaacggtcatctgcagatgcaggcggccatgattccctacgcccggattacgaccattgacagcttctgtctgggaatcatccgggagcactataaccagctggacatcgatccggcttttcgtgtgggggatgaaggggaactcctcctgcttcgcggctccgtgatggaacagctgctggaggactactatgaggccggggatgaggaattttcccggtttgtggagacgtatgccaccggcaaatcggaccggggcatcgaggatcatattatggctgtctacaacttttccggaagcaatccgtggccggaaaaatggctggaggcctgcgaaaaggaactggaggactacgaggagggaagcgacgacaggcttatggagacggagtggatgcgcttcctgatgtgggatgtcgccatgcagacaggggaattctgcgcccagctgaaggaggcgcttgccgtctgtgacgaggaaaacgggcctgcggcctatatccccatgctgacatcggatttgcgcatgctgcaggcgatcgggaacgcaaaggattacggctgccttaatgaactgttaggcagcgcctccttcgaccgcctggcttccatccggagcaaggagatcgacgcggataagaaatcgtttgtgaccggatgcagggaccgggtaaagaaggcggtcggaaaactccgtgatttatactgctttgaatccattgagaccgtggtgcgtgacttaaggggtaccgcgggtgcggtgcggattctgctgagactggccggagaatttcacgaccgttaccaggaagccaagcaggaaaagaacctggtggatttcggggatctggagcattacgcgctggaggtgcttctggaagagacggaggagggagaacgaaccccgtctgccgcagccgacgagctgagccgccagtttgaagaaatcctggtggatgagtaccaggacagcaacgacgtgcaggaggcgctgatccacgccatttccagggaacggttcgggacgcccaacgtgtttatggtgggcgacgtgaaacagagtatctacaaattccgtctggcaaggccggaactgtttttaaagaaatacgaatcttatcccagagaggacggcctgtatcagacgattgagctgcaccagaatttccgaagccgggacagtgtgctttccggcattaatgaggtattctatcagatcatgacgaaaggtctgggcggaattctttatacggaagacgcggctctccatcccggcgcggtatttgaaccgacggaagagatggttggaggaaaactggaacttcatatggtcaacacgggaggcggactgttaaaacagctggaggcggatcctgcggacgattatacggcccgcgagatggaggccaagctgatcgctgcccggatgaaggatctgataaatcctgagacagggttaaaggtctgggataagaaggaaaagcgctacaggaccgcctgttacggcgatatggttatccttctgcgcagcttaagcggatttgctgaggatttcgtcaacatcttaatgaatgagggaataccggcctatgcggagcggagaaccggctactttacggcgattgaggttgaaacggtgctgtgcttcttaagcatcatcgataatccgatgcaggatattccgctggctgcggtcttaaagtcccccatcgtgggagccacggacgaagaattggcccgccttatggccgtgttcaagagaacggcgaaaaagggacaggacaggggaatctacggggcgtggatgtattatctggaaaactgtccggaggatgaacgggagggagcgctttacggaaagctcgcggcgttttccgatgaactggcagagtaccgccgcatagccggctatctgtccatccatgagcttctgtatatcatctatgaaaataccggatattacgattatatcgcggccatgccagcgggagaggcgagacaggcgaatttggacatgctggtggaaaaggcgtcagcctatgaaaagaccagctattccgggctgtttcattttatccgctatatcgagaacttaaaaaaatatgacacggatttcggagaggccgccctggccggagacgagaataccgtgcggattctgagcattcataagagcaagggactggaattcccggtagtctttctggcgggcatgggcaagaagtttaataaacaggatttatatggaaagatcctcattgacccggatctgggaattgccacggattatctggacttagagctgcgagtcaagacaccgacattaaagaagaatgtccttcggcggcgcctggagctggaagcattgggagaagaactgcgtgttctctacgtggctatgaccagagcgaaggaaaagctgattatgacgggcacggaccgctatctggataagaaactggagcgtttttccgatattaaaaggacggccgggcagattccgtttaccatcctgtcaacggcggattcgtttttggactggctgctcatgagcctttccggaaaactgtcggagtcggcgcttctgtcggacgcgggagcggaaacaggcctgatgacggtaaggtcttattccgtggccgatctggtaggtgtggagatcgaacatcaggcggaaaagaagctgtctaaggaagaactgctaaactttgactgcgcccgtatttacgatgaagcgtatgccgcaggcatatccgcggcctttgcataccgttatccccataccgcagacatcggcctccacacgaagctttccgtatcggagcttaagaaacagggccagctgatcgatgacgaggagagcaccttcctgcctacgattccggcctttctgctggaagaaagcgggaaaaaggatcagggcggcggcgcattccgcggaaccgcctatcaccgtgcactggaactgttaaatttccccggtatgaaaaccatttccgatgtggagatggcactggatacattccgcagggagaagtacatggacgaagtgagcctgtcccttctggatgccgggattttatggaatttcttaagctctccccttggccggcgcatgagtgccgcgcaggccaaaggcctcctttacaaggaacagcaattcgtcatcggaattccggcccgcgagatggaggtctgcagttccgatgagctcgtcctgattcagggaattatcgatgcatatatggaagaggaagatggcctcgtcctgatcgattacaagaccgaccacgtggtgagaggccgggaatccctgctgacagagcggtacgggatccagctggagtactataagcgtgcattggaacagatgacagggaaaaaggtgacggagaagattatttattcgctgacgctgcaggaggagattgtgcttgagtaggaggaatccagcggcagccggtcgatgggaaggccgaaagggaaagaactttgcataaacagatcggttttattgtagaacattcattctttttgcggtataatgaaagtgtattgataaaatagtcaggataaaaaaggatatggtgattaggttggcagcaggaggtgaaaaatataatataagaaatgaaagacttgatcactggttaatatgatatatttcatgaatctgcgaaaggagaaggcgtctatgacaattcaggtatcggtaaataacgaggcaaaggagaaagctgtggccagattgtatgaattgcttgcactgcaaagtaaggttgaacagcagtttaacggttatcgttataatgtttttatctttggcagttatttgaccaccaggtatgtagaaggaaagagtgatattgatatcgcagtctatacaaaggactttgaactgtataaacgtctgtcactgtacttggaagaatatttcaatcataaaggagtagccagtgatattttctatattgatacaatgatggaagctccaatttattgtgcaccacttaaatccaaggtgcagttcacagattactatccggaagagttaataaaattcaggcaggcatgtcaaagaaagctggaagaaaccaaagcgaggatggtcggatgaagtttagcgaagatattttaaaacaatttgatctggagcgggaagaagaaaaagaaccggtgaatgtcatgaggatcagtgagatgctggactttatgaagttatgtgcagaaagaattcaccataaaagtaaacggtatatggagtgcagcgacgctgaaaccaggatggactgcatggatattgtaacggctaagctgaatgattttactcaggtgtttaaggatctggttatttttatgcgtaaagaagaaggaacatataaaggcagcgcttctttgcggtattgtatagccggctttgatacatttgagtttgaggaaacagatgtggaaaaggcatttttacgggagctgttgctgagaaatgaaattacccatgattattttaaccgcgagcttcatcagcagaaattgatatggctgatgatgaattacagtggtggggcgttggatgtatatagagatttaaatgactactgttcgaaacataatctgttgaatagatatgctgataagaatttgcagccttgaatttcatgagatattttagtaagtatgttgtactataaggagctgtggcaaaatcagatgaataatctattggagcatcagctccttttctatgcaaaaaaacagaacgatactggtgttattcgacttaatttatctaaaatctatttagtattgctaaaatatttttatgtgctacaatgataatagataaaatctataaataagggagcggggaaaacatgataccagacaacgaagtaaggctgacacaaatgacaaagacagcgggctgtgctgccaagattggtccggggactctggcgggggtactggagaatcttccaaaggctgaggatccgaatctgctggtgggaatcgagacctccgacgatggagccgtataccgggtgaacgatgaactggcgttcatacagacgctggatttcttcacaccggtggtggacgacccctatacgttcggccaggtagcggcggccaacgcattaagcgatatttatgccatgggcggagaaccgaaggtggcgctcaatatcgtggcctggcccaactgcgtcaatccggcatttctcggtaagattctggagggcggagcctcaaaggtcgcggaagcgggagcggtcctggcaggcggccattccgttcaggatgatgagccgaagtacggcttaagtgtgacgggattcgtccatccggacagaatttttaaaaactgcggcgcaagaccaggcgatgtgctgattctgacgaaaccactgggaacaggtatcgtcaatacggcggtgaaggcggatatggcttccgaggaggcgaaggcggaggtgatccgggttatgacctccttaaacaagacggccaagcgcgtgatcgaacagtttgacgtgcacagctgtaccgatgtgaccgggttcggcttagcaggtcacagcgtcgagatggcggaaggaagcggtgtgactctggaaatccatatgtcggatttaccgcttcagaaggaagctccggatctggcaaagatggggctgattccggcgggagcttacagaaaccgttcgtttgttgagaataaggttgatttcggggatacagaggagtttctgtgtgatattttctgtgatcctcagacctcggggggacttttagtcagcgtcacaccggaggatggagaaaagataacggccgggctgcgggaagccggtttggagactgcgtttgcggtgattggctgtgtgaaggaactggaagataaattcgtgaaactgaggtgagattatgatctatctcgataatgccgccacctcgtaccaaaagccggaggcggtgtatcaggcggtacaggaggccatgcaccatatgggaaactccggcagaggggctcacggcgcatccctggatgcgtccaggcagatctattctgccagagagctgctggcggagctgttccatgcgggagacccatcccgggtggcgtttacggccaattccaccgaaagcctgaatatggcagtcttcggcctgttcggaccgggagatcacgtaatcaccacaatgctggaacataactccgttctgcgtccgctctatcttctggaagaagccggactggagctgacgattcttcccgctgatcaaaatggctgcatctgctacgaggatattgaaaaggcaatcagacccaatacgaaaggaattatctgtacccatgcctccaacctcaccggaaatatggtggatatcggacggattgggcgcttctgcagaaagaaaggcctgcttttcgttgtagatgcttcccagaccgcaggcgtgttcgacattaatatggaagaaatgggaattgatgttctctgcttcaccggacacaaaggcctgctcggccctcagggaacgggaggaatctgcgtgcgccagggtgttgctgtgagacctctcattgtgggcggaagcggagtccacagctattcaaaggcccatccggaggatatgccgactgctttggaggccggaactttaaacggtcacggaattgccggactttacgcagctttacgctatattcaggaaactggcatggagcagatcagggaaagagagctttctctgatgaggcagttttacgatggggtgaggaccattccgggagtgaccatttacggcgattttacggggcagagggcgcctatcgtgtcactgaatatccgggattacgattccggtgaggtggcggacgagctggcgtatcactacgagatctataccagggcaggcgcccactgtgcgcctctgatgcatcgggcgctggggacggagagcaccggagccgtccgtttttccatgtcacactttaatacggaagccgagatcgacgaggccgtccgcgcggtacatgaaattgcaaacacgctctagtgcatcccggcttaaatacgccttgtatagtgcctgatatctgcgtcagggcgtctgcgaagcgacggcgtagtggagcctacggctagcttcgcaggtgtgcaactggcgtagagagcaggtgctatgcatggtgtatttacgccgggcggcactagtacggacaactggaattccggcttctgacagggggaaatgtctatgaatctgaaacaactggaggcctttgtctgcgtggcagaggtgaaaagcttttctcaggccgccaagaaactgtatctgacccagcctacggtcagtgcccatatccattcgctggaaaaggagctgggggccaggctgtttatccgcacgacgaaggacgtggaattatcaccgtccggggaactcctgtacgacaatgccagaaaaatgctgcagctggagaaaaatattctccgcgattttacgaggaccgatacgccgggcgttcaaaagataacggtgggagcttccactgttccagggcagtatattcttccccagattctttccctgttttccaggacgtatcccggtaatcagctggaattaatggaggcggacagcctggaagtagtgcgcatggtgttggatgggaaggtggagatcggctttaccggtacgcggctggaggatccgacctgtgtgtttgagccgttttactacgaccgcctcgtggtaattacaccaaatgtggagacataccgggaatatgagaagaccggctttcccatggaacgtttctatgaggagaaatggattgtccgggaggacggatccggaacgcgaaaggaaacggaacagtatttgaaggaacacggcgtagatttaaaacgtatgaacgtggtagctacaataagcaatcaggagaccatcaaaaaatcggtcagcaccgccatgggaattgccattatctccagtgccgcggtggaagattatgtggctcaggggcagcttctgcgttttcctctggcagagggcgatatttaccgaaaactttacatggtctggagtaagagcaataagcctggcaaggcggcccggctgttcatacagtttgttagggaactgtatgcttacttatagataaaatctataagcgtaatacgattatcaattagacagaggtccctttctttgctacactgatttcataaaatttacgtaacaattcagagcggcgggaaaattggcgcaaaaaggacgttgagcttgctcataagaccgtctttgcaccaattttcacatcggatgaatatccggtgtttcttgaatggctgtatcattcaagaagataagccgttcggaattgttacagtgaagaaaagggggacaacatgaatttgacggaatcaaaaaaaacactggcgttatcaggggtagtactgggtatcgttgcggcggctctggccttcttcggaaacccgaagaatatggcgatctgcatcgcctgctttatccgtgatacggcgggggccatgaaattacaccaggcggcggtggtgcagtatgtgcggcctgagatcgtcggaattgtggtgggagcgttcttgatatctctgatcacaaaagaataccgctccacggcaggctcttcaccgatgatacggtttgtgctggggatgatcatgatgatcggcgcccttgtatttctgggatgtccgctgcgtatgctgatccgtatgtcggcaggcgatttgaacgcctacgtggctctggttggctttgtgggcggcgtctttaccggaacagccgcacttaagaagggcttcagtcttggaagatcttatgaatcaagaagcgtcagcggatacgttctgccggtccttttggttatcgtactgatcttgagcgtgacgacgactctgatggcagtcagcgagaaggggccgggaagtatgcacgcgccggttctcattgcactcgtgggagggctggtattcggagcggtctcacagaaatgccggacctgctttgccggaagctttcgagatgtgattttaatgaaaaactttgatttgattacgatcatcggagcatttttcgtagtaatgcttatctttaatattgcaaccggagggtttaagctttcctttgacggtcagccggtagcccatgcacagcatttgtggaatatactcggtatgtatgtggttggatttgcagccgtccttgcaggcgggtgtcccctcagacagctggtgctggcgggacagggatcttccgattccgctgttaccttcctgggaatgttcataggcgcggctctctgtcataactttggacttgccggcgcggcagcagcggcagcgacggacgcttcaccagcggtagccggaggcccgggaatggctggaaaagcagcggttatcatctgtatcgcggtgctgtttgtgattggttttcttccgggaattcagcgggagaaaaaatagaagaacagaaatcagagatcagagatcaaaggtcagaggtcaaaggtcagagattggagatcggagatcagaaagtgcagagaacagatcaggaggaaacccacatgtacgaagtagatgcaagaggcttatcgtgtccggaaccgttaatgctggtgtcggatgcattgaaatcccatccgggagagaaattgaaagttttggtgagcgaaccgcattccagaacgaatgtagagaagtttgttaagagcagagggcttaccgtgctggtaaaagagactggttcggagttcgaactgacgatagaaggatagaaattaatgaggcaaaaggaaaataaagtgatcgtgactttccacacaacggcggaagcgattgcgatggagaaagcctgtttaaacggcggaatcccgggccgtcttattccggtcccgcgccagatttcctccggatgcggattggcctactgtgccgccgcagagctggaggaaatggttttaaaatatatgaagcaaaatgatatgcattatgaagcggttggtgtgtatctgatctgattcgattcgatggaagcaaatgaggcggtttgatgcggaaagcagagagcagtaagcagagagctgaaagcagagagcagagcgcagaaagcagagtgcagaaagcagagtgcagaaagcagtaagtagaaagcagagagcagaaatcagaaagtagaaattagaaatcagagagcagtaagcagaaatcagtaaagtagagatcagaaatcataaaacaaccaacaaccaacaaccaaccaacagcaataccagcggtcagatctctgaccgccttttttttaactaataattttttagatttatagaaaaaaactataagtatcctttccgaattgtattcaaaatatccacccaaaagacagaaataaagaaaaatgcacaaaaatgaaaatggtattgacaaatagttgtacaatatggtagactcaaactgtcagaggtcagaaaatttaatagagataagtattcaaagaaacttatatatgctcataattggttgagcgtttctaccaactaccgtaatagttgtctataagtttttgcatgactgtcagcacgatcagtaaagactgcaaaagacaccagtcatgcgaaaattataggggtgacggtggtttttttttgagatggaagtcgtccggacgcgattttacagctgtctctcctataacaggaatacggaataggagggaaaatggccggagataagaattttgtactgaagggaaacatctgttacagcgaagatgcaaagaacttaaaactggtagaagccggatggctcgtctgcagggaggggctgtgtgccggagtttttgagacactgccggaggaattcgcatcgtatccggtgacggactgcggcgatcagatcatcacaccaggacttgtggatttacatgtccatgcaccgcagtatgcgttccgcggtctgggaatggatttagagcttctggactggctgaataccaacacatttccagaggagtccaagtaccgggatttagagtatgcgaagagcgcctatggaatttttgctgattccatgaggagcagtgcgactacgagagcctgtattttcgcaaccatccataatcaggcgacagagcttctcatggatctcatggaggaaactggattaaagaccatgatcggcaaggtcaacatggaccggaactcaccggagtacttatgtgaagagagtgcagagcagtctgcggccgacacggtgaagtggctggaagacacggcggatcagtatgagaacgtccgtccgatcctgacacctaggttcattccatcctgtacggatgagctgatgaggaagctaaaagaggttcagaagaagtatgaccttccggttcagtctcatttgtctgagaatcagggcgagatcgcatgggtacaggagttgtgcccggagtcacgcttctacggagatgcttacgatcagtttggcctgttcggcggagatgtgaagaccattatggcccactgtgtatcctcgaccgaagaggaaatcgagttaatgagagaacgcggcgtatacgtcgcccactgcccggaatccaatacgaacctctcatccggtgttgcaccggtgagaacctatctggacaaaggcgtcaacgtggggcttggctctgacgtagccggcggaagcaaggaatccatattttacgccatggcacacgcagtccaggtatccaagctgagatggagactgcaggataccagcttaaaaccgcttaccgtggaagaagctttctatttgggaaccatgggcggcggctcattcttcggaaaggttggaagcttcctggaaggctatgagtttgacgcattgattctcgacgacagcgatatccgccatccgcagccgctttccctgaaggagagactggagcgtttcatctatttgtctgatgagaggcatataaaaggaaagatcgtagcgggaaacagaattttctgatataattaaagaaaagtgtaaatttaaaactgaatatgaatttcgagaagttaccatatacgaaagaaacccatatatactgagctgcgtggggctgctctgctatataaacgaaaatcattcaactatcaaggaggtaggaagtatggaaacgaagggaaacgagaacttttttgagaaagtgttccacttgtcggaaaaccacacggacgtcaaaaccgaagttgtagccggtattaccacatttatgaccatggcatacatacttgcagtaaacccgagcatcttaagtgcgactggtatggacagcggcgccatattcacggcgactgcactggcggcactggtagcgactctgttaatggcagcatttgcaaactatccgtttgtacttgcaccaggtatgggattaaatgcgtactttgcatacaccgttgttttgaacatgggttacacctgggagatggctctggcagctgtattcgtagaaggtcttatcttcattcttctgtcactgaccaatgtgcgggaggcgatcttcaacgcaatcccgatgaacttaaaacacgcggtatccgtaggtatcggtctgttcatcgcatttatcggccttcagaacgcgaaaatcgttgtggacggcgccacacttgtttctgtttactccttcaagggtgctttaacggatggaaccttcaattccgtaggaattacagttttattagcaatcatcggtattcttattaccgcaattttagttgttaagaatgtaaagggcaatatcttatggggaatcctggcaacctggattcttggcatgatctgccaggcggtcggcttatatcagccgaatccggaacttggcatgtacagcgtattcccggatttatcctccggtttcggtatcaagagcatggctccgacgttcttcaaactggacttctcaagagtgttatcccttgacttcctggtagttatgttcgcgttcttattcgtcgatatgtttgatacgctgggaacgttaatcggtgtagcttccaaggccgacatgcttgataaagacggaaagcttccgcatatcaagggtgctttgatggcagacgctgttggtacatccgtaggcgcattattcggtacttccaccaccaccaccttcgtagagagcgcttccggcgtttctgaaggcggcagaacaggtttaacggcagtagtagcagccattttattcggcttatccttattcctgtccccgatcttcttagcgattccgtcctttgcaacggcaccggctctggtagtagtaggattcttaatgcttacttccattacgaagatcgacttcaacgattttacagaagcaattccatgctacattgcaatcatcgccatgccgtttatgtacagcatttctgaaggtattgccatgggcgttatctcctatgtagtcatcaatctggttacgggtcacgcaaaggagaagaagatcagtacgctgatgtatgttctggcggtactgtttgtactaaaatatatattgatttaataatatatagagcaactgaaaatagcaacctgagcaaatcaggagaaccggtcatgtagacattgtcaaacgggctggcggcgacatcactttgatggatgaaattgtcctgaaaaagtctcgtcgctgccagcctttcttattttttaagaacaggggccggccggagcctgattagcaggagaataaaagaaacaggaggtaggataccatgggagttggtaataacatggtccgcgttgacgccatcgagaaagtgaccggcggcgccaaatatacggcggatttggaaccaaaaggacttcttgtggctaaggtcgtaagaagcacaattgccaatggtgtagtaaaaagctttgatttggaggcagctctggccgtgccgggagtcgttaagattgttacgtgttttgacgttccggatattcagttcccgacaccgggacatccctggtctgtggagaccgcgcaccaggatattgcagacagaaagctgttaaataccagagtccgcgtctacggtgatgacatcgctgcggtaatcgcagaggatgagatcgcggcaagccgtgcggcgcgtctggtgaaggtggagtatgaggagtacgaacccatgcttaccgtcgaggctgccatggcggaaggagccacggttcttcacgaggagaagccgggcaatgtaatcgcccattccagctttgtagtaggggaaggaacctatcaggaggctgtggaaggagaggacgtgacagagatcgatcatgtctatgcgacgcagagcgttcagcactgccatatcgagactccgatttcctttgcttacatggaaaaaggaaggattgtcgtgacgacttcaacgcagattcctcatattgtacgccgtgtcatcagccaggcgctggggattccggccggtgaaatccgcgtgatcaagccgtacatcggcggcggattcggcaacaagcaggacgtcctttatgaaccgttaaatgcgttcctctgtacccaggtgggcggaagaggcgtccgcatggagatttccagggaagagacgctggcctgcacgagagtgcgtcatgccatcaagctgcacgtgaaggcggcagtgagaaaggatggaacgctggtagcgagaaagctggaggcatactccaaccagggcggttacgcttctcacgcccacgccattgtggcaaacacatccaatgagttcaagcagatttaccacgacgagaagacgctggaatccgacgcttataccgtctatacgaatattaccacgggcggcgccatgagaggttacggaattccgcaggctgcatttgcagcggagtgtatggccgatgatctggctgtggccgttcatatggacccgctggaattcagaatgaaaaactgcatgccggagggctatgtggatccccatacccacgttgcatgtaatacatacggcttaaaggaatgtatggaaaaaggccggaactatattcattgggacgaaaaacggaaagagtatgagaaccagaccggtcctgtcagaaaaggaatcggtatggcgatcttctgctataagacaggagtttacccgatctctctggagaccgcttcctgccgtatggttttaaatcaggatggctccatgcagctgcagatgggcgctacggagatcggacagggcgcggatacggtatttacccagatggccgcggagaccaccggtattacggaggacaaagttcatattctctctacgcaggataccgatattacaccgtttgatacgggcgcttacgcatcccgccagacgtatgtcagcggtatggccgtgaagaaggccggactcattttcaaggacagaatcctggattatgcggcatatatgctggataaagagaaagacaccatggatatccagaataacgtggttgtcgataaggagagcagggagaagcttctcgatatggcggagcttgcgacgacggcgttctacagcctcgaccgctcgatccacatcaccgcggaggcgaccagccactgcaaggataatacctttgcaacgggcgcctgtttcgcagaggtggaagtggatatgcctctcggcaaggtgaaggtgaccaatattgttaatgttcacgacagcggcacgctgatcaacccgaagctggctgaagcgcaggttcacggcggcatgagcatgggacttggatacgcgctcagcgaagaactcctctttgataagagcggcaggccgttaaatgacaacctgctggattacaaactgcctacctccatggacacgccggatctccacgtgcaatttgtggaactggacgatccgacgggtccatttggaaataaagcgttaggtgagccgccggctattccggtcgcaccggccatccgtaacgcagtgttaaacgcaactggtgtagcggtagattccctgcctcttgacccgcagaagcttgtggctcattttaaggcagcggaactgatctagaagggacggtgatattccatgtatgatattgaaaaattataccaggcaaaagatataggggatgcgatccgtgccttgaaggaagaccccgaggccgtcgtcatttccggcggcagcgacgtgctcattaaggtcagggaaggcaagcttgccggatgttccctggtcagcattcacggaatcaaagaactggaaggtgtgagaatggaagaggacggcaccatcgtcatcggtccggcgaccacattttcccatgtaaccaataacaggattattcagaaatatatcccgattttaggggatgccgtggaccaggcaggcggaccgcagctgcgcaacatcggtacggtgggcggcaatgtctgtaacggtgtgaccagtgcggacagcgcctcatccttctgctgtctcgacgcggtcttagtcgtcgaaggaccggagggagtgcgggagattccgatccgcgagtggtataccggcccaggaaagacggtaaggcagcacgacgagatactgactgccatccggatccgcaaggagtcctacgagggctttggcggccattacatcaagtacggcaagagaaacgccatggagatcgctaccatgggctgcgcggtcacagtaaagctgaccgaagataagaagcacatcgaagaaatgcacatcggctacggcgtcgccgctccgaccccgatccgctgctttaaggcagaggaaaaggtgaaaggcatggaaatcggaaatgagctgtttgagacgctgggcaagagcgttctggaggaagttaatccacgtaccagctggagagcttccaaggaattccgtttacagctcatcgaagagatggcaaaacgtgccctgaaacaggcgattataaatgcagggggtgaatgcgatgcttaagattgttcatatgattgtcaacgataaagaggtcgaggtggcggtagacgacagggaatccttactggagacgctgagggaccgtctgggccttaccagcgtgaagaaaggctgtgaggtcggagagtgcggcgcctgtaccgtcttagtggacggcgaggccatcgacagctgtatctacttaaccatgtgggcggaaggacgccggatcatgacggtagagggcttaaaaggtcctaacggcgagctgagcacgatccagaaggcatttgtggaagaagcggccgtgcagtgcggcttctgtacgccgggtctaatcatgaccgcggtggagatcgtgggaaccggaaaacggtacaaccgcgaggaattgagaaagatgatatccggccatctctgccggtgcacgggatatgaaaatatcttaaacgccatggagagaatcgtggaagagacttataaggtggttggcaaagaggattaaagggagaagcgtgttactgttttcatagagcttcattatgttttggattgtttcgaagagagaaaaagccggagcggcgacatttgggagagtgtcgccgctccggctttttgggtgcggtgaggtgcggtgaggtgtggggcggagaaggggaagattggattgttgggggatatttagacatgtttcggaaaaatgatgcggaagcagactgtcagacgcggcatttctatggtatgatagatgagacttaagtgacacctttaagaaaacgaggacagagcgtatggaagacgggctgagaaccgtgatgaaagaatacatcgatcaggtaaacgacgtttgcctccgtttgctggctggcctctgcctgaaatccaaagcggattttctgtgcagcagaaagctgcgctggggcatcgagtatgagatcaacggaacgaagtatctgcttcatggggccggatgccgggcctgtgacggggaacggtatctggactggaactttggctatggaagcagatggtgtggaatagacccgtggcttctcgccaggacgctggaatataaccgggatccgcatacagaatactacgacggaaaccgagtgaaagcggaatgtgaacaggcggtatcgcttggcgaaatgtatcagaagcacaatctctattacttcacaattcctgtcagcgaaacctttgaaccacagtttcccaaagaatttgatactctgatcgtggaacattttgaggaccggtgggtgatcccgaggaaccggatggttgagcgcttcttgagaaagagcagaagggtgtacagggaaatcggcagcagcctgaataaatatacactgagattcatgctggacgggaaagagaccggtacatttctgtacgataatgtctgttatccggagcgtgcggtgacgattatgagagaaattctgataaacctcgggagcggtacagacaaaccacagagaatggagaacagatgaaatatttaatatacggagcaggaacgatcggaataacctatggatggctgctgtctcagaatcatgagatcgacctgctggtgaagccggagcactatgaaaaactgtctggaggagtggttttatccgttaaggacttgaggaagaaggcctcctcttacgagaacgtgactttttatcccagctgtgtgacggaagtgacagaccattacgacgggatcctggtaactgttaaccggtgtcagctggcgggcgttctgccccagctttcagagctggctgaatatacaaaatattttgcatttatgcagaataactggaatgttcaggcggagatcgaggcgtacttatcggcggatcagtatctgattgcgttcccttccagcacgggaggcggccgcgatgaagccggtttaaaggtcatcctcttcgatgaggcagtaaggctgggcggaaaatgccgggccgggcttggcgacatacagacagcgctgaatcagtccgggattcgtacggttttcgataaaaatatctttgactggatgaaggtccactatttgcagcagtctgttacggcgggcgctgtgctggaatgcgggggctacggctcatttgcgagtgactatcaggccgtcaaaaaggtggtcaaggcgtttcgggaggggatcggtgtgtgccggatgcagggagtcgatacgaataagacatttccggccggcctgttcaaactcccgacatttgtggcagcccatattatgcagaacatgtttttagaggccaacaccagggagatggtggaaaaccatatgaagaaggggctcccggaatgggcggcgggctatcaggagatcttaaacgccggaacgtgctgcggcctgcctatgacggtatggagatcgtacgatgaggcggtggaaaagtactgcctggaacagaccttgaaatgttaaaaatgcacaaaaaacagaaggattttttattagtttatacagattgcagaaaatgagactgtctgctatactaacacacagtaagaattgcaccttgataagtacatctctatatggctgtttaaaacatagctgggttcacgcggcatattttctcccaatttatattcggcgacattcgtcttgacgatatgaagggacgaatcgtgagcgtccctgtccgccagcagtataccagaagtatagttgtatgaaacaatgcatatttttacgtaaaaaattcaggaggaattgaaatggcagaaactctattgatgaaaaacgtaaagtatcttgtgacatgtgacgacaacgacaggtttatgacggatattaacatgctggtgacagatggggtaattacctacattggaacagaagaaaaaacagctgataaaataattgatgcgtcccggatggttgtctatccgggacttattaattcccatcatcatttatatcaaaccttcacaagaaatcttccacaggtacaaaacatggaactctttccatggctgaaaactttatatgagatatggaagggcatcgacggcgacagtgtctactacagctccttaaccggaatgggggagctgttaaagactggctgcacgacgtgcttagaccatcactacgtgtttccggagcacagcgccggagcacttcttgacgcgcagtttgcggcggcggacgccctgggaatccggatggcggccacgcggggcagcatggatttgagtgtgaaggacgggggactgcctccggacagcgtggttcagacgatcgatgagattttaagggattcgcaggcggtggttgagaagtatcatgattcttcccggtattccatgcacaccgttgcgctggcgccctgttcgccgttcagcgtgaccggcggtctcttaagagaatcagcggttctggcccgcagcctgggagtccgcctccatacgcacctggcggagacgaaggacgaggaggcgttcaccctggagcattacggcatgcgtccgctggcctatatggagagcctgggatggatcggagacgatgtctggtatgctcatggaatccattttaacacagaggaactggaacttctggcagcgacgggaaccggagtggcccactgccctgtctccaacatgaagctttcctccggcattgccagaatcccggaaatgctgcggatgggagtgaaaaccggactggccgtagacggaagcgccagcaacgacggctccaatatgctggaggagatgcgggtggcctatctgcttcaccgcctgaattccagcagtgaggctccttccggttacgatatccttaagatggcttcgagagggagcgcatcgattctcgggcgagaggaactgggatatttagccgaggggatggcggcggatttctttgccatatccctggaccgcatcgagctggtcggcggacaatacgacccgaaatcactgctgtcctgcatcggattcaaaggtgctgtggattacacggttgtgaacgggaaggtcgtggtagagcagggccgtctcgtcaatgtggaagaggaaaagatcgtatcgaaggccaacgcggctgtggaaaaacttctgaatataaagtgaggatcgtgagatgaatgagaaaagaaatgcttcggtttttgatttaaatggaatacccaaaatgtcccagacactgcccctggcgctccagcatgtggttgccatgatcgtaggctgtgtgacgccggccatcatcgtcgcgggagtgacaggcgccagccgggaggaccagattatcctgatccaggcggcgctgctcatatccgcggttgctacgctgatccaggtgtttcctgtccataaatactgcggctccggccttcccgtcattatgggcgccagctttgcatacatacccatgctgatatcgctgggaagccggtttgacctgcccaccattttcggcgcgcagctggtgggcggcgcggttgcgatcctggtcggtgtcttctataagaagatcaacgcgctgtttccacccattgtgacgggaactgtggtctttacgattggtctttccctgtatccgacggcggtgaattacatggcaggcggcacgggagcggcggactttggaagccctcttaactgggcaatcgcactttttacgctgggcgtcgtacttttctgcaatcactttacgaaagggatcacgaaaatggcatcgatcctgatcgggatggcctgcggctacgttctggcccttgtgctgggaaaggtttccttcgcgcccgtcgcggaggcgggatggtttcagattacgacaccgctgcattttggcattaaatttgaactcacctcgatcatatcgatgacaatcatgtgtattgtgggatcggtagaggcaatcggggactttacctccacagcgggaggcggcctggaccgggaggccacggagaatgagatgtgcggagggataatcgggaatggaatcgcctgcattctgggcggtctgtttggcggaatccccacggcgacattcagccagaacgtgggaattgtcattatgacaaaggtggtaaaccggtttgtgatcggtacggcagctgttatcatccttctggccggatttattccgaagttcgcctcgctgctgacgacaatcccctcctgcgtgctgggaggcgcgacggtgtccgtcttcgccatgatcgccatgacaggaatcaagctgatcgtgaaggaagagctgaccgcccgcaccatctcgatcgtgggcctttccgttgccgtcggtatcggcgtgatccaggctccgggctgtctgggactgttcccggactgggccagaaccatatttggggaatcggcggtcgtgatgtccagtatcatgtcgattgcactgaatctgatccttccgagggaagaggcggaagcggaagagatggtgtatgaggcggagcgtgtttaaggagctttcgttttgcttggaaaatgtgatttttttctttgagtagtgtggcataaaaaacgccttttacataacgaataggacataacgtataaagccgtcttgtattgacaaggcggctttattcagttctcatcggcagcaaacgtggattcgagggcctggagcgttgcataattcaccgaaacttacgccctagtagtccgtactctaagcccttgtgtatagagtgcctgatatccgcgtcaggtgtgcgtctgcgaagcgacggcgtagcgggccctacggctagctttgcagacgtgcacctggcgtggatagcgggggctctatacacaaggacttggagtacggactactaatatgcctcaatgcaataagcttgtatgcgatcgatagagattcctttacttctcgatattaccgttcagcctgatgatttcctgacgcaggcgctccagctcatcatctttccgttccagctcatcatctttccgttccagttcattatctttccgttccaacgcttctgcaagtcttctgatctcttcctgctgttcctcaatcatcagttccactgtgttcttatcatacatggccagcgtctcattgtacatcgcaatcaactcctccggttccctctgaaatgcagctatttctttgtatagttccagaaaagcgggatacgtctcaatcactcgttttatgtcttctggttcatccgtgctcaaaaaatacagccacgcatccagctctttatctatattgtgagtgatttccttaaaaatgtcaagcgctataaagatatattcctgcagcagattcagctccagtcctgtgtcaaatttttgactggagcgatggatgtactggtccggaaccttatgaaattcagacgaactgttctccaccaatacgatcgtatagaccttctggaggtcgcggtatgaaaactttttctttttcctgctcttttgccggtcatattgacgaatgaccagatccgaggaatagcaggcgcttctctgtccaggaaagtggtatcccaccttctgaatctccacattggccaacgcaccgttttccagttccacaacgatatccatgataattaacgacgcctcggccgccagacgtctggactgagaaggcagaacctgttttaccgttactttctgtccaataataaccgtcagcaggcgggacaatcgttccccgtgaagtacgggatcatatatgtgtttaaaaaacgggtcatatgtgatctttaccccttttgcacccctgacaatgtcaaaaatctcccttttgtagtcttcggtcaggtttaaatactcttcataggccggcgacgtctccagaattctccgagcctccttttcgggcagcacaataccgcccataccgttagacagatactctgtgtttttcatacgcatgatctcctttttcagatgtgtttgagtgaatagattggcgaaatgccagataatcagaatgaacggaagaggttccgctcataaagtgaatgtatttattatagcagagtaacagggaaaatggaacagaaagattagaaataatgccccatacaatccggctgttacaattcacagcaccaggcggcagaggctcgcggtggggccgtgaattgtaacagccagctgccccgataaacaggaggaacaaatggaatgcatgtggcctgcgtactgcctgccttatttccctgccccgcaggagcttctcaaaatcaactgcggatgcagcaggatcgtgccgatgggaacgccgtttaacaggctgtccagcgcgtagtatccgcactttcccagctgagggcggtcctggcggatcgtggttaaggggggcgccgtgtagggactcatcggcagatcatcgaagccgataatgcttaagtcctcggggatcttctttcccagctcctggcactggaccatggccgcgttggccagctggtcgtggctgcagatgatggcggtcacgcctcgttccagaagccgcggcagatgcttctgaatgcattcagaaatgtaataggagcttccggacagctgaggatcggctggaaggccgtttgccttaagcgctgcgaagaaggcccggtgacgtactaaaaagacgtgggagcccagcgccccgcttaagtatccgatcttcttgtggcccaggctctttaaatggttcaccgccagctccatcccctcgtcgttatccacggcgacgctggcgacggagggattccccatgacataattgtcaaacagaaccgcgggagtgcggctcgtcttaaaatccgcgatccagggttcacttaaggagatacccatgaccagggagccgatgtaatcgttttccagcatgaacacgtcgtagggagtggtcttctgcaggcttttggtgatgggaaccacgtccacggttaagccggccggctcggccatctggcgaaaccccataatgatgtcgtagccgaagtgcccgggcgaggtgtattccatattataaataaggacgcagaccttcttggaaacatttctttttctgcgaagttttgtgtatcccatctcgactgccgtctctaaaattgtttttcgtaaagtttcgctgatgtcgggggcgtcactcagggctttggataccgtacccttggaaatccccagtttatcagcaatatccgctatcgttaccatattcttctccagttctttccgataattcagtcagccattctggctgctttccagtccattatatataaaataatgaaaaaatgcaataaaagatacaaaattaaaataagaattttcgacttgtttcgtctgaatgccaaaatgttaaaacaaatgaaccgttctttcgttgaaaaagagatggatgaagagaagaaaattagataaaattccttaaaatagtcttgatgaacggaaaaagatggagtatgatacaaatatacgaaactaaacgaaacttttaaaggaagtcactgcacctcagcttgaaataatctcgacatatgccggtgacacgtatcacatgcagaagacagaaagaacggtctctgcgtgcttataacaaggaggaagatgggaatgaagagagagttgggattaacgctcaccctggcggcggcagccgtgatgaccgccggaatgcttggcggctgtggaaaggcatcatcgggacagggaggaagggaagaggtcagactgatggtgtggtcgccttccgaggaccagtcgaaggacagcggccagtggctgcagacgagctgtgaacagtttgcgaagcagcatccggaatgggatatcacgttcgtgtatggagtcgctgacgaggcgacggccgccaaccaggtggcgcaggacgcggaggccagcgcagacgtgttcatgtatgccaacgataccttaacgatcatgacagacgccggtgcattggttaagttcggcggaaagtaccgggaagagattgaatcgacaaactcgaaggaagtcatcgattccgtgaccatggacggtgagttgtacggtgttccgtttactaccaacacctggtttatgtattacgacaagagcgtattttccgaggaagacattaagaacctggatcagatgctgacaaaaggcgtggtttcctttccatttaccaactcctggtatttaccttccttttatataggaaacggctgctccctgttcggggacggaaccgatgagtcacagggggtcgatttcggcggagagaaggcactggaggtcaccaactacttagttgatttaatcgccaatccgaatttccgggtggacgcggatggatcgggaatggccggtctccgggacggaagcatacaggccattttctccggctcctgggatatggcgtcggtgaaagagatcctcggggacaacatgggcgtgtcggcccttcctgcctatacgttaaacggcgaagagcggcagatgacggcgtatgccggttccaaggcgatcggagtgaatccggagtcgtccaatatggtccctgcggtccagcttgctgtgtacttaggctctgcggaggcacagaagcttcactatgaactgagaaatgtggttccgtgtaacttagagctgatggaagaaccggccattgccagcgacgcgctggtggcggcacagaatgacaccttcaaccgtacgtcgatccttcagccgttcgttgcagccatgaataactgctgggttccggtggagaacatgggcaagggaatccggaatgggaacgtaacccacgagaatgcaggggaacagacggaagccatgaatgctgcgatgaacagcaatggaatttagggggatgaatctatgggaaagaaattagaatttgcagcagcctggtccttccgggaggcgcttaaaaacggcggcgcagagacgaagctgtccatggttttgatgggactcggaaatattgtacataaacaggtcgccaagggcctgatctacatggcaatcgaagcggcttacgtggtatttatgattatgaccggctttcactgcatctccatgctgggaagtctcggcaccgtggggcagcaggtggtctgggacgaggtgaaccaggtctacttatatacgaagggagaccagtctgtgctgatcctgctgtatggagtggcggtgctgtttctgaccgtacttatggcggccgcatggtacggcgcagtgaagagcgcctataaggccgagtgcctcgataaggcgggaaagcatgtaaacaatttcgcggaagatgtaaagagtctgctccatgaaaatttataccgcctcttcatgacgccgccgctgacctttatcttcgggtttaccgtgctgccgctgatcttcatgatctgtatggcgtttaccaattacagcaaaatcgacaaccatctggttctgtttgactgggtcggcctcgataatttccgggcgctgtttgattccagcagtatcctgggaagtaccttctggtcagtcctgtcatggactctggtgtgggcgttttttgccaccttcaccaactatatcttcggtatgatcctcgcgatcgccatcaaccggaaggagacgaaggccaaaggcttctggcggttctgtttcgtcctttcctgtgcggttcccatgttcgtatcgctgctgattatgagaacgatgctgcagcccaacggcgccgttaatgtgctcctgagaaatatcgggctgatcggagccgatgccagccttccgttctttaccaatccaacctgggcccgcgtaaccattatcgtcatcaatatctgggtcggagttccctacacgctgcttcagctgaccggcgtccttcagagcatcccggccgacgtatacgaggcagccagagtggacggcgccaatgccttccagaccttctttaagatcacgcttccgtatatgctttacattaccacaccgtacctgattgccacctttaccggcaatgtcaataacttcaatgtcatctacttattatccggcggcgatccggtgacggatttagcctctacggcgggcaagacggaccttctcgtcacctggctctataagctgacgattgataaacagtattacaacatcggcgcagtcatcggtatcctgacgtttatcattctggccgtgggagcgctgctcacgtaccgcaacagcaaatcctataaagatgaggaggcattctaatatgaagaaaatgagatcggcaaaacaggttaagacggtaaataatatcctggttcacacggctcttgccattctggcggcagtctgggtgtttcccatcatctgggtggtgctcaccagcttccgtgcggaaaagggctcctatgtgtcaaccttctttccgaaggcgtatacgctggcaaactataccaagcttttcacggatacgacgattttaaacttcccgcgtatgttcgccaatacgctgttcatcgcggtgtgttcctgcattctgtccacgttctatgtgctggcggtatcctactgtctctcccggcttaagttccgtatgagaaagccgtacatgaacatggcgatgattctgggcctgtttccaggcttcatgtccatggtggcggtgtattttatcctgaaggctcttggactgacggaaggcaatctgatccgcctggcgctcatactctgttactccggaggcgcgggactgacatttcagattgccaagggcttctttgacacggttccgcgcgccatcgacgaggcggccctgatcgacggctgcaaccgctggcagatattttcaaagattacactgccattaagcaaaccgattatcatctacacggtgctgacctcctttatctcaccgtgggtggattttatcttcgcaaaggtaatctgccgcgccaattcggaccagtatacgatagcgatcggcttatggagaatgctggaaaaggaatatattgacaactggtacaccagctttgcggccagcgcggtgctgatatccataccgattgcgatcctgtttctgtgtatgcagaagtattatgtgaatggcatgtccggtgcagtgaaagggtaacgcagcatcaggaaggctgaggaatgactatgacgaagaaaatgacagcaagagagctgaaacgcttctatgcggacagcacatttaagaaaaattacatctatgacggccatgatctgggtgctgcctgcggcagtgacgggactgtgtttaagctgtggagtccggtcgcggaccgggtggagctccatctctacccggatggggacgagagcggctgtatgcgctccgtctccatggaacggggagagaaaggcgtatggatgtaccggacggaggaatgtcttcacggtacgtattacgattacgatgtgagcattggccatgagacacgccggaccgcggacccgtatgcaagagcctgcggaatcaacagcaggcgcagtatggcggtagagcttggaaggacggacccggaaaggtgggaatcggaccgggccccgaaacggcagcaggaagacatcatctacgagcttcatgtgaaggagttttcctgggacgggagcgcgggatttccggaggagttaaggggaacgtaccgcgcgtttacagtggaggatactaccctgttcggggatggcgtccacccaaccggaatccggtatttaaaggagctgggcgtgacccatatccagctgatgccggtctatgatttcggctccgtcgatgaggccggggaccgggaccagtttaactggggctatgatccggtctgctacaatgtgccggaaggctcctattccaccgatcccgcccacggggaggtgcggataaaggaactgaaggagctggtgcagacgctgcaccggaacggttttcgggtcatcatggacgtggtttacaaccacacctactcggcggactcttccttccagcgggttgtaccctggtattactaccgccaggaggaagacggaacgctctccgacggctccggatgcggcaatgattttgccgccgagagggagatggctgcgtcatttatcctggactcggtcctttactggacagaggaataccatatggacggcttccggtttgatttaatggggctgctcccgacagagctgatgaaccggatccaggaagagctggataaacggtacggcatgggtgagaagctgatctacggggagccgtgggctgcgaacgggacgcccatggaacccggatttcatcaggctttgaaagaaaatgaaaagagactgaatccccgcgtcgccatgttctgcgacaacacgagggatgcggttaagggccacgtgttcgaagccatggaaccaggttttgtaaatggtggggaaggactggagcgggagatcatgcacgcggcttcagcctggtgtgacaggggcggggcattccacgctggttcgccggaacgggtcttaagctacgtttcggcccacgataacctgacgctctgggataaactgatcctttccatgacccataacgatcattcgctggcgctgcacatgagccgctgtgacaaaaaaggcttttatgaaaggccggaggaggtcgtgcgggcgtataagctggcggtttctgtgtattttacatgtcagggacgcttattcttcctttcgggcgaagagtttgcgcggacgaaggagggagatgacaacagctttgaagctcccatttccttgaaccgcctggactataaacgggcgtatgaattcgaagagctggttcatttttataaagacctgattgcgctgagaaaatgccttccgggcctctgcgataaaacggaggaagccggaaaacgtatttttaagaagagtgcaaaccgaaagggcgtcgtcagcttccaggtggataaccgttacaggggagaggggctctgtgacacgctctttatcgcctacaacagccgccgccgtccggtgaaggtgacacttccggaaggggagtgggaagcttttttaaaggatggagacagcgggatgtggagacggccagagagagagacgtattcgggccttctgattctgccgccggtttccgcggttatcatgggacggaaaacagagattaagcaggaggcagcgcgatgaagtttgtatatggaaaacaggattttaaaacactggagcgcggccaggagaactgttatctgcttaccaacgggctcggcggcttttcgtcggaaaccgtgatcggctcagctgcccgcaacgaccacgcgttttttatggcctgtacgaaggcgccgaatcacaggtatcacatgattcacaggctgcgtgagaggctggttacggcagagggcgcggaatatctctccagccaggagtttgcagacggaaaggaaccggaagacggatacctccgcctgtcctcctttcagttcgaggattgccccgtgtggatgtaccacacggccggagtcgaagttagaaagacagcggccatgaaacagggggagaatacaattgccgtccggtatgagattcagaatcacaggagagaggcgtgtactcttgaagtagttcctttcctgcagtttgtaaagaagggggacgatctggacatggatcaggcgttttcctgttctgacggccgggtcagttcggcgggattggacctctatttttctacagacggcattgtgactgccttcaaaccagtttatgagacgtactactacgcttatgacgcctgtgacggacggagggagaccgggaaggcgctggccaaccatgggatcagcttaacggctggcgccggagtgtgttccagtctggaaatcgtatactctctggaaccggtgacggaaacggcagaggccatactggaaggcgcggtccgatatcgccgggagctggagagacaggccggttttcagtctgaggcagcttccatgctggccaagagcgcggcacagttcatcgcccgccgggaaaccaccgggggagatacgattctggccggatatccgtttttcgaggactggggccgggataccatgattgcgctgggcggatgcgctttggcgacggggcggttcgagacggtaaagagcattttaaggacatttttgaaggcagagaagaacgggctgatgccgaatctcttccctgaaggcggcagcgagcccatgtacaacacggtggatgcggcgcttctttttatcaacagcgtttatctgtattttgagaggacaaatgacatatcctttgtaagagagtgctatccggtcatggagcatatcgtgaggcggtacgaggaagggacggatttcggtattcacatggacgaagacgggctgatcgccgcaggacagggcttcgaccaggtaacctggatggatgtgcggatcggcgatatactccccacaccacgccacgggaaaccggtggagattaatgcttactggtataatgcgctgcggattatggagagattgggcgggaccgcctccgccgctcgctacggccgtctggcggagcttgtaaaacagtctttcaatgaaaaattctggctggaggaaaaacactgcttaaaagatgtgatctccgggacagaagatggcggcagagcgggcgctgacaatcaaatccgctgtaaccagatctgggcggtctccatggctttttccatgctttcaccggaaaaagagaaacaggtggtggaaactgtggcggaaaagttgtatactccttatggactgagaactctctcagaggatgagaaggagttcaagccattttacggaggcagccagcttgacagggatttggcgtaccatcagggtacggtctgggtgtttccgctgggcggatactacctcgcatatctgaaggtacatggatacagcagggaggcgaaggcggaagtatgccgccagctggaggttttggaaggcgccatgcgggaaggatgcgccgggcagctgcctgagatttatgacgggaaaaatcccgtttcttcgaaggggtgttttgcccaggcgtggagtgtgggagaaatcctccgtgtatatgaagctttggaaaaagtataagtaaaggagaatcgatgatgatggaacaggaattaaataaagttctgggcgaaagatttggaaaaactcttgaggaggcctgtatggaggaaatctaccatgcgcttcttaccattgtaaagggcaggatgaaggacctcaaaaagaatacgggcagcaggaagctctattatatttcggcagaatttttaattggaaagctgctttccaacaacttgatcaacctcggcctgtttgatgagacggcggaagtcttaaagaagcacggaatcgatattgcggatatcgaggaggcggagacagagccatcgctgggaaatggcggcctcggaaggctggcggcctgcttcctcgactcgattgcgacgcttgagctgccgggcgacggcgtgggcttaaattaccatgacggcctctttaaacagacttttgcagaccataagcagagggaagagaagaacccgtggatgaccggggacgactggctgacaaggacggacgttcggtttgaagtgccgtttaaggatcttaccgtgacctccaccatgtatgacattgacgtgccaggctacaaaggcggaaagaattcccttcatttattcgatttagactcggtggacgaatccatcatccatgacggaatcgagttcgataaagaagatatccggcggggcttaaccctcttcctctatccggacgacagcgacgagaagggacagcttctgcgcatctaccagcagtatttcatggtaagcaacgcggctcagctgattttaaaagagacggaagagcgcggatttgatctgtaccatctccatgagcatgtggtcattcagatcaacgatacccatccgaccatggtgatcccggaactggtccgcctcctgatggcaagaggctttaacatcgacacagccatcgatgtggtgagaaagacgtgtgcgtacaccaaccacaccatcctggcagaggccctggaaaaatggccggcttcctatttggaaaaggtggttccgcagctgatgccgattatccgggagctggataagagggtgagacgcgatttccacgatgagaaggtctatatcatcgacgagcaggaacgcgttcatatggctcatatcgatatccattacggacagagcgtcaacggcgttgcggctcttcatacacagatactcgaggaatcagagctgaagccgttttacgatatttacccggaaaaattcaataataaaacgaacggaattacattccgcagatggctgctgcactgcaaccatgagctggcttcctatattgaggagctgatcggatccggctataagattcacgcggaggagctggaaaaactccttggctttcaggatgacgaggcagttctggaccgtctccgccagatcaagcagaatgcaaagctggaattaaagaagtatttgaagagcacccagggagtcgagattgacgaaacttccgtttacgatatccaggtgaagcgtctccacgaatacaagcgccagcagatgaatgcgctttacgccatttataagtatctggagatcaagaagggcaatctgccgaaacgtcccattaccatgatcttcggagctaaggctgccccggcctatacgattgccaaggatattatccatttaattctctgtctgcaggagctgatcgacagcgacccggaagtgagtccgtacttaaaggttgtgatggtggagaattacaatgtgagcaaggctgcgaagctgattccggcctgcgacatttccgagcagatttccctggcttccaaggaggcgtcaggaaccggcaacatgaaatttatgttaaacggagcggtgactctgggaaccgaggatggcgccaatgtggagattcatcagcttgtgggcgacgataacatctatattttcggaaaatcctccgatgaggttattaagctctatgaaaccagcggttactgctccagaaagatttatgagagcgacagcctcgtggaggagctggtggactttatcatcagcaagaagatgatcttaaccggcgatccggttaatttaggaagactttataaagaactggtttccaaagactggtttatgacacttctggatgtgagagagtatatcgcggtgaaagagcagatgctggcggattacgaggatgagcgttcctgggcccgcaagtccctggttaatattgcgaaggccggatacttctcttcagacagaaccatcgaggagtacaataaggatatctggcacctgtaaaacggatggtttacgctgcaaagtgagtgtgaacggaagcaatgatacgctggaggaaatggaaagactatggcagacagaaatgagcaaaaatggtggaaaacatcggtgatctatcagatctatcccagaagctttaaggacagcgacggcgacggaatcggagacttgaacggaatcatagaaaaactggattatctggaggaactggggatcgacgccgtctggctttcacctgtgtgtaagtcacctcaggacgacaacgggtatgatatctcggattatcaggatatcgatccgctgttcggaagcctcctggatatggaacgcctgattaaagaggcgggagagcatgggattaagatcatcatggacctggtcttaaaccatacgtcggatgaacaccggtggtttttagaagcgaagaagagtaaggataatccctaccatgactactacgtctggcgcgacggtgaggagggcgttcttcccaatgacatgagagcctgcttcggcggcccggcatgggagtgggtaccggaactgtcacagtactattttcatcagttctccgtcaaacagccggatttaaactgggaaaatgaagccgtacggagggaaatctacgagatgatccgctggtggatggacaaaggcgtgggcggcttccgcttagatgtcatcgatcagatcgccaaggaaccggacttaaagattacgggcaatggaccgcgccttcatgaatttatccacgaattgagccgggagacgttccagaagggcgattgtgtcaccgtaggcgagtgctggggcgccgatacggagcgtgcaaagctctatagcgcgccggatggaagcgagttctccatggtgttccagtttgagcacatcatgctggattccgtaccgggcagggagaaatgggatctggccccccttcctttcgtaaaactcaaggaagtattaaacaaatggcagtgtgagctgcaggggagcggctggaacagcctcttctgggacaatcacgatctgccgcggatcgtatcacggtggggcaatgacaaggagtaccgtgtggagtcggctaagatgctggccacggttctccacggtatgcagggaacgccctatatctaccagggagaggaactgggcatgacgaacacggactatgagatcggagagtatcgggacatcgagacgcttcatatgtatgaggaacgtctggaagccgggtattccgaggaggagatcatgcggtccatccacgccaaagggcgggacaatgccagaacgccgatgcagtggaactgcggcgagggagccggatttacagatggaactccctggatccggatcaatgggaattacggggaaatcaacgcggaaagagaactggcggatcctcaatcggtcttccattattataagagactgatccatttaaggaaagagtatcctgtctttgtacatggaagcttccaactgcttctggaggacgatccgaatatttttgcatacgtaagagaatgggaaggcgtccgcctgctggtactctgcaatttcttcggcagtgaaatcgagtgccctctgaaggagatgtgggaaggcaaatcccggctcctgtgcaattaccaggatgcagagaatgaggagattttaaggccgtatgaggcccggatgattctgctttaaggaaggaacgctttggcccggaggctgaacctgtggaggaaaactgcaggggaggcgccgggctttcgcataatcataaaataaattccaaaacgggggtctgcccatgagcgccagttcggtaacagaatacacagatagcttaagtgaggacggaaaaaagtatgtcagcgatttcatcggattcatgcgcaaacagtatccgcagatcgattctaaaatatgcttttcaatgccgatgtggctggcgggagaaaaaatgaaggacggatatatcgctgtctccgcggccaaaaattatttttccatccatttttcagaggaaggatatgtaaccaacatagccagaatggtacctgcctgtaaaaccggaaaacagtgtatcaatatcaaatatggtgatgacgagtcctatcagattgtgaaggatcacgtcagggattttttgctgcgccagtaacggcttatggggactgtgcccgccggagtgttccggcgcacacggtccccatggtttatttcaggccgtttatgttgtccacgaattcgctgtttctggcagtcagttctacccaggccggccgaaaaccgcattttactgcgttgcggacggactttaagttggaccatgcggcacaataaaagggaactttccccaaagcgatgatttccagcgccagtttgctggtcaatgcggccgcgatcccttttcgtctgtaagcaggaagaacgtcgatcccgatctgatacatggtttcacagtcggcagagcagccggcgagtccgattagcctgccgtgatcgtaggctcccacgccaagaacatcgagccctctgttttcgctggatagggcgttgctccattcctccgtatacagatcagaaaaatcgcctttatgcaggattcttgtctcgaattcacagggcagctccttcagctgtgtcagatcaggcagaaagtattctgccataaagcatacctttaaatcgtaagcggccagagcgtcgtttaaagcgtttatattaggcgtctcaaaacaatgctcaaccggatatttttctatgtagacgctaacaatgccggccagccgttcactcacctgagctacaatgttattgccgtaggataccagatcacattccagcggcagaggaagatattttctcgcgtttctgtgcggtttcgacagtacaacccggttttctgcctgcaaaaaatcttccgcgctgcagctgcagtcgactgcggattgttccaatgctatttccagtatttccttattcgtcataaataatctcctcaaagtgaagcatatcaattgaatgaaagtaacttttcctcacattcataatacctggagtatcggatcgcgggtaaaatatcatgggaaattccctcctctttcagaaaacgggaggcttccataatttcctttagcgacagactcctgttcagcttttcacggttttctatctgtcttttcatctccagaacccttatatgcagcatcgagcccaattttacgagcactgccgccggtatgcggtcttctctgatccaaaggcagtagggcttcctgtcctgctcacaggggctgtagaagctggctccgacgacccggcagccgcagctttggcattccagtaccagactgtggccttccagaaatgccttcgtgtcttttccgtggcactgcgtgcataccagactggataagtccgcattacgtatgcagcaggcgctgcaccagatccacaggccgccccgtctgggcctgtcggccctcagatagatatggccgcccctgtgcccgcagactggacagacagcggggaattcacaggtgtccagcagtgattccatagaaatgtccgagctatgccacatgatacccctccctttttctttcatcctgtgaatccattgtaccataggccaaagattcgtgaaagactttgccgtgcggttattgtaatccgtacgcattgcaattgcccctttctttcgctataatggatgaatacaaatggcaggaggaattgacatatgatacgatgtgcaaccataggaacaaattttgtggcggactggtttatgaaggcggtccaggcgtgtgacgggatcacctgcagcctggttcattccagaaacagggagacggcggaggcattttgcaggaaacacggagcggggcggtggtgtacggatttaatggaggttgcggaagcagaggatgtagatgcggtctatatcgccagccctaacagccttcattacgaacaggcggcgctgatgctgtcccatggtaaacatgtgctctgcgagaagaccataacctcgaatgaggcggagcttaaggaactggtccggattgcgggagagaaccgcgcagttcttatggaagccatgcgttcggtccatgaggaaggatttttgcagctgagagaggtgcttccgatggtggggacgatccggagggccagcttccagtatgcgaaatattcctcgcgatacgataagtttaaggaaggaatcattgaaaatgcattcaacccggagttttccaacggcgctctgatggacatcggagtctactgcgtccatccgctggtacggctgtttggtatgccgaagaagattatcgcagattccctgcttctctccaacggtgtggaaggagcgggtaccatcctggcctcctacgatggcatgcaggcggaacttctctattccaaaatcaccaataaccgccttccaagtcagattcagggagaagacgggactctggtgatcgacaatattacgaatatctgcagcgtggttttccatgacagaaaaggcaatgcggaaacggttattgatcttcctccggagcacagcctggatggagaagtaaaggactggctccgcatgattgagtccggggaaggagttcgggaagacaacgaatgttccctgatggaactgcgtgtgatggatgaggcgagacgccaggcgggaatcgtcttcccggccgatctccgcaaaattaccgggtgttgattatatgaaagcaaagggggattacctatgtattattcgacgacctgtccgtcacctgtgggagtgataaccctggcctccgacggagagaagctggccggtctgtggctggagggacagaagtattatggcggtgcgatcgcaggcagcatgacagaaaatgatgatgtgccggtgttcagcgccgcgaaacagtggctgaaccggtatttttcaggggagaaaccgttggcctcggaactgcccctggcgcctgtgggcagcgaattccggcagaaggtatgggagattctctgcgaaattccgtatggcagcgtgatcacctacggagatatcgcaaaacggatggctgtgatgttaaacaggcccaccatgtcggggcaggcggtgggcggagcggtgggacacaatcccatttccattatcataccgtgccaccgggttgtgggcggaaatggaagcctgaccgggtatgcaggcggaattgccacaaagatgaagctgctggagctggaaggcgtagatatgtcctccctgtttattcccgcgagcagcgagccaaatggacacgctggcgcgtccatttgacgactgccgcgagggggagtgcgctctgaatgcgagaaacggtacaggccaggggcgggccgcagtttcagactgattcggccggctcctggtattgctggctcccccctgttttaaacgaccgcgtatatttatccccatacagggtcatgaagtgtgattttcatcagacattcaccgtctcccatcttaatacttttcagcagttccacgtcagcctcacaggcaaacgcatgctcaaagaggaccttgctgtaccctgtcgtacactgacaccaggtattcgtctccagcttatccacttccgccagcatggggcagggacaaaaatggaactgcagaaagagttcgccgtctctgcaggagagtccggcggcttttgctttctctgaatttgcaaactcttctatgcttgatacagatgccttcagttcctttacgagcgcagctttctcatccattccataaccgcattgacagttccttcttattttctttatggtatcagattcaaatctgctttccaggcggtgcatggcagactttacccactcagaattgctttctgtatttgttgcctgttccttaccataaaccacttcattcgccagatccgcgctgctttccgctttgacagattcgtaaatgaccttctcttgtatttttcttatatcaaacattgttttcctccatattcatgactgggtgtgtaatgttagctgagtaatgttagcagggtaatgttggctgagtattgttggttaagcatcgttcatgaagattcgttccttgagcggtactttctgttctggtagccgcttctgaaaaacatcttcccgatcatctcacatacctgatggtggaccgcataaaaaatgacctcctttctgcataaagtgtttcgaacacttttattatagaaagaaagccatggtgttgacttctgaattcttgctgttatgagcttgttatgaaatggggatgcataaatccataacaacgctgtgattgccgcggtcaatgctgcgatacagattcagtccgtaacgccgtgccatgtgataaccgctctgcggcagccagatgttgaagattccctgcagcgtctcgaagatgtccttgatttctccgtcgtaatgatacacaatccatttgccgcctctgatccgcataacgtgatccagactgcagtccggctctgctgtcatgcagagatcgcagatgcactgagatgcatttgtaatcgccgggtcattgaaaaagcgttcgatcagaacggtctcttccctcaaaaatgctttgtattgatcgaaaaactgataccagtgcgtctcaatgtccacatagcttccaataaaacgctcatatatcacaaatatgtccggaaaatcctgaatttcgattcgtgctgcgtattcttccgcagttttgaagcgggcagtccgctccggggtaaagggaacaggcatgctatgagccggtattgactgcttgtaccccgtaggggaggtatgatggcgctctttaaatacggtactgtagttggaagcgctgtatccgtaatccagaccaatgtccgtaatggctttcgttggattcagcttcagatccacggcgctctggtcaaccttacagcgtttgataaacgcataaacgctttcgccggtttcttccttaaatatccggctgaaatggaattttgatatgtaaacatgagcggctaagcggtcaagcgacagatcctcatctaaatgccccattatataatcaatgctttgattcacaagattttttctgtccatagttctccagttctttgctgtatttaagatacgtttattgtaaaatctttgcctcacgctgtcaatacatgggaacggagtggaaggaaatacctgtaccaggccataaacacatcgcccggctgcataaaaaagcgcccaatgaccagtcaatagtcattgggcgcttttcctgtgaaaggatggatcttatttcacttttttaccttctctcggaaggataatattcagcagaaccgccacgatggtagcgactacgaccggtgaacggccgaagatggtgactacccagctggggaatgtggaaagtgctgcggtggcctgggagatacccatgccgagcgctgcggcaagtcctacgatagaagagttgcggtaagtcatctcttccgacataacgagcttcataccggtcatggcgatagaagcaaagactgatacggtcgcgccgcccagaacacattggggaatggtggtgagcagtgcggagaacttcgggattaaaccggctgcaaggagaatgacagcggtaagtcccaggacacagcggttgacaacctttgtcgtcgtaacgataccgacgttctggctgtaggttgcggtggggaggcctccgagcagggcgccgagaatattagtgacaccgtagcccatgataccgccctgaagttccttatcggttggttcacggtcgatagaaccgctggtagttgccgtaaagtcgccgatcgcctgtatggagttgatggcgaacaggattgcaatggcaatacaggaagacggttcaaacatgattccaaaatgaagaggctggggaacctggaaggctgccgcggaaccgatgctggcgaaatcgaccatgccaaagaagagtgagacaacatagccgacgatgatgccgatcaggatcgaggcgagcttaaagattcctttgccgaaatggttcagtacagtaactacgacgagggttaaaaatgcaatcccccagttctgccaggaaccgtatgtagggctggaggtacctccggccatgtaattgattgccgtcggatataaggataaaccgatggtgaagaccacggtacccgtaataagcggcgggaaaaacttacggatctgcatgacaaaagcacccacaatgaaggcgacaacgccgccgacgatctgagcgcctaaaatagcaggaacgccgtagtctgctgcgatcgactgcatgctgggcacgtaagcaaagctgatgcccatgataaccggcagagcggctccgagatggaacccgttcttcttaccgatggggaaaagctgcagtaatgtggaaagtgcggatacgacaagagcagcctggattaagataacccggtctgcggtggaaaggtttgcaacgttggatacgatgatggctggcgtaacgcagccaacgatcatggctaccacgtgctgaagtgctaacggcagtgcctgggagaattttgggatgccgtccatctgaaatatagaagcgtattctttacttgactgtttcatagagagagttcctccttaggttattggaagtactccgggaaatcggattgcggtttcccggcagaaaattactgatgaatgcgagtaccggttttccccaggattccctcttttgctttttcaagcagagtgatgagtgcgttgcgcccatctttggaatctgcgaatttcacagcagcctgcactttcggaagcatggagcccggcgcaaaatggccttcgtccatatactttctggcatcgtctgttgtgatatcgtccaaccatttctcttccggttttccgaagttgatagcgaccttttctactgcggttaagatgattaagaaatcagcgttcagttcttccgccagcagttcacttgcaaagtctttgtcaattacggcgcttgcgccttttaaatggtttccgattaaagtaaccgggataccgcctccgccgcaggcgatgaccagctgtccggagtccacgagggagcggatcgcaccgatctcaatgatttcggcgggctttggagatgcaacgacacggcggtagccgcggcctgcgtcttccttcatgatatatccatacttttcttccgcgatcttagcctgatcctctgtcatgaaatggccgatcggtttggaaggtgcgttaaatgcaggatcttccgcatctacacggatctgtgtgatcatggtagtgaccggaatatccgtgatgtttctgtttaacagctcttctctcagtgcgttctgcaggtcatagccgatgtaagcctggctcatggcaacacagacggagagaggagtattaggctgagacggatcttcacggctcagtgcgctcatagcgttgttgatcatgccgacctgaggtccgttgccgtgtgcaacgacgacctcgcagccttcctcgatcaggtctacgatcgctttcgcagtgattttaactgccgtcatctgttctggcagtgtgttgcctaaggcgttgccgcccagggcaatgacaattcttttcttcttatccattgaataaaccctccaccggttttataaaaaatccaaaaaaggacgcacctgctactcgctggcagcgggtgcgcccggattcatattcttcttatttgaatacgcgtggcgtgtttctttcttccagcttctttaagatttcctgtggattctcaaacttggcaaggaagatcatagcggcgattacgtatggcttgaagcttgcttctttgtataacggatcgcggtaacgatcgaatacggaagcttctacttcaccatctacacagcttacgtcgttgatatcagccggtaagcagtgtaagtacagggccttgccatcctttgtggtcttcataagctcttctgtacagcaccagtctttgtggtctgcattctgagccagtaattctttctccagagccttgatgccctctgtatcgccttcgccgtataagttggttctcttttccattgctgcgaatggagcccagctcttcgggtaaacgatgtcagcgtctttaaatgcgtcagccatgtcatgagatacacggaaggaaccgccggacttctcagcattatttctggcaacttcctcaacctcaggcattacttcgtagccttccggatgagccagaacaacttccatgcccatacgtgtcatcagaccgattacaccctgaggaacggataatggctttccgtaggaaggagagtaagcccatgtcatagccagctttttgccctttaagttctcaaggccgccgaactcatggataatatgtaacatatcagccatacactgtgtcggatggtcgatatcgcactgtaagtttactaaggttggcttctgctctaagattccgtccttgtggccctgtgttacagagtcaacaacttcgtgcatataagcgttgcccttgccgatgtacatgtcatcacggataccgatcacatcagccatgaaggagatcatgttggctgtttcacgaacggtctcgccgtgagcaacctgagacttgccctcgtctaagtcctgaacttccaggccgagtaagttacatgcggaagcgaaggagaaacgggtacgtgtggagttgtcacggaataaggagattccaaggccgctctcgaatacctttgtggaaatgttgttttctctcatgaaacggagagcatcagctacggtccagacagcttccagttcttcgtctgtcttttcccatgttaagaagaaatcattgttgtacatttccttgaaatttaaagcgtttaatttgtcgatgtaatcctgtaaggttttcatattggtataaagcctcctgaaataaatgtaatgttatttggtatctatcctgcatgctgtccagcctgtcatagatttggggaaggaatgagggccgacggcaagagtgattgtttttaggggtggctgcattttcttcaacaggaaagtacatcctgtcgaagaaaaccctccgggtggatgcgcactgcgcgctaaggtaatatggctgcggtagcagccgcgcttcggcgcacgattccggaaaccggattcgattgaatctgcagccggcatatatggttacaaaatggcaactgattggctaagtattatttctcgcagtagatagaaggaagtgctgcgtaaactgctgcacatgttactaaatcctgcttccatgtcttctcgttcggagcgtgagcctgagcctctgcgccaggtccgaagccgatacacggaattccgttgcgtcccatgatggaaacgccattggtggagaatgtccatttgtctgtcaatggacgggcagttctcatggcaagtgtttcttctgcgccgatacggacatcgccgtataagttcttgtaagcctcttccagagatgcggttactttgtgatcctccggaataacccaggtcgggaagtagcactcgatcggataagtaagtcctttataggaaggacgggaatattcatacatggatacggttacgtctccgccgtacttctttacgctcggtaagttgcggatttcttctaagcagctttcccaggtctcaccagctgtcatacgacggtctaaggataccgcacaggagtcagcaaccgcacagcggctcggtgatgtgaagaagatttcggaaacagtgacagtgccgcggcctaagaagtttgcttctttccattctgcgttgtagctctcgtctaacatcttaacgagaccttttacttctttgtcatcggctgcgtcgttttcatttaaggcgcgtacatcctgaaggatatcggccatcttgtagatcgcgttgtcaccgcgctccggagcggagccgtggcaggaaacaccctttacgtctacacggatttccatacgtcctctctggccgcggtagattccgccgtcagtaggctctgtggagacaacgaattccggacgaaccttgtcttcgttgataatgtactgccagcagagaccgtcacagtcttcttcctgaacagtaccggttacgagtacggtgtatttgtcgcttaaaagtcctaaatccttcatgattctggctccgtaaacggctgatacgataccgccgcactgatcggaaacgccgcggccgccaatttcggtgtcattctcgtagccttcgtatggatcgaagttccagttgttcttgttgccgataccaacggtatcgatatgagcgtcgaaaccgattaaggttgcgccggttcccatgtaaccaagaacgttgcccatatcatcgataacaaccttgtcaaattcaagctttctcatctcttctgcgatgcggtcgatatgagctttctcgtcacagctctcgcctgggaattttacgatgtctcttaaaaatctggtcatatcagcttcgtaattttttgctgcctctttgatttttgcgtaatccatgattttaataccctccgttttattattttttatggtgttcgattgcctaacgttcttttccttcccaaacgatcgctttgtagcgttccgggtcggtgtcgccctccgtagagaagaggagaacttttgaatcctgattcagtcctaaatgctctcttaaatccttgtactcatccatggtcatgatgcaggccagaataccgaatggagctgcaccggactcaccggacgtgactgatacgtctcccttaatcggagctgccagcattctcatgccttttgctgctgcccagtcaggagcggagacgaaggtgtcaacgtggttctttaagatatcccaggagatggtgttcggctcgccgcaggctaaacctgccatgatggtctgcatatcgccgtctacgatctgaatgccgccgtcgccggctttcgcacccttgtagagacaggctgcaacatcagcttccacaacgacaaccttaggcgggttttccggataacggtttgcgaagtagccctgtacagctcctgcaagagaaccaacgcctgcctgaacgaatacgtgagtcggtctgtcacatccgtattcctctaactgctcgccggcttccatcgccatggttccgtatccctgcatgatccatgccggaatctcttcgtagccgtcccatgcggtatcctgtacgacaacgccgtgctctgtcttagaagcggcatcggctgccatgcggacacattcgtcgtagttgacttcctcgatggtaacgtcagcgccttctgccttgatgttattgaaacgggtgatggtggagcccttcggcatgaagacaactgccttctgtcctaaccggttggccgcccatgcaacgcctcgtccatggtttccgtctgtggctgtaaagaaggtagcctggccgaattcctcgcggagtgcttcggaagtcagaacactatatggaagatcggagacgtctttgcctgtctgctgtgctatgtacttcgcaatcgcgaaggaaccgcccaaaaccttgaaagcgtttaaaccgaagcggtaggattcgtccttcacataaacctggccgagtcctaagtattcagccatatggtcgagctttgcaagtggtgtcttgctgtactgcgggaagctctcatggaatttccttgcctttccgatttcgtccagcgccatgacagataaattcttgtcgtctgtcttcggcatggtgttaaccacccattcgattggattcatgatgtttgattctccttcttattttaataatgaatttaaaatggaaattttattgaaaacttatttattctcttttccggcatccatgtagctgtaaagcgtgaacttggatattccgaaaaagttggaaaccttgtcgccggattttgtgatcaggaatgctccggcgtcgtttaaatactgaatcgctgtgatcttgtcatccttgctcatcagcgccaccggtttgccgaccagctgtacggactgttcgatgagcgtatctaaaaggtcgttgacgttgtgcgtgatctttcttggctgccggtcttctccggacatctccgcggtggagatgagagagcggatcgagttgtcaacagtgagcaatcctgtgatgtcataatttaaggaaaagatataatcgatggtaccgtcctttcctcttatatacatggtactggattttaaaatccttccgtcatctgtcttcgttaaataagacagccggtcttttaagcattcaggattccggttcagcgtttcaagaacgatttccgaaggtccgtctcccagttttcggttgcttacgtgaccgttttcgatatagacgatggagctctctatatcctgcttttttaagtcgtggatgaccacctcacaggcgtttccaaaatgggatgccacaccgtgtgcaatctgtgtcagttgttcgagctttgaatccatcttgtaaccccccttacttgatttcttatactcccatcataacataaaaaaatgaaaaatcaataccttttctaaaaattttttaggcaaactaattttttttgtattttaatcttgcatttcttacttttagatgatacactgtacctataaagatatttatggtacaaactgcataaaaatgatgagaagggaaaagttctaaaggacaatatgcaagaacaatgcacgggaggcggggaaggtcccatgtgcacactgtatactcaaaatttttgagattttgacgaaatattaagaaaaagagagaaaaggagatggagacatgctgattatcggtaatggaagaatgatcacaagaaacccggaggctccgtttttggaagatggagcagtggcgatggatggatccactattatgaaagtaggaacgacaaaagagataaaagaggcatatcctgatgcagaatatatcgacgccaaaggcggcgtcatcatgccggcgtttatcaacgcgcatgagcatatctacagcgcatttgcaagaggcttaagcatcaatggctacgatccccacggtttcctggagatcctggacggaatgtggtggacgatcgaccgcaacttaacactggaggagacaaggctttccgccatggcaacctatatcgattccattaagaatggtattaccactaccttcgatcaccatgcgagcttcggccacatacgcgattccctgtttaaaatagaagaagcggcaaaagagaccggcgttcgctcctgcttatgttatgagatttctgaccgtgacggcatggataaggccagggaagcggtaatggagaacgcggcctttatcaaacacgcgctggcggacgacagtgatatgatcgccggaatgatgggcatgcatgcgcagttcactatttccgatgagaccatggcactggcagcggccaacaagccggcggaggttggctaccacattcatgtggcggagggcatcgaagaccttcatgactgcttaaagaaatacggcaagcgcatcgtagaccgtctgatggactgcaatatccttggtccgaagacactgcttggccactgtatttacgtaaatcctcacgagatggaattaattaaggaaacagataccatggtcgtacataatccggaatccaacatgggcaacgcctgcggatgtcctccaaccatggagatcgttcacagaggaatcctaaccggtctcggcactgacggatacacacacgacatgacggaatcctacaaggttgccaacgtacttcacaaacaccatctctgcgatccaaacgccgcctggggcgaggttccgcagatgctgttcgaaggaaatgcaaaaattgccaaccgttactttaagaagcctctcggcgtattaaaagaaggcgcagccgccgatgtcatcgttaccgattatatcccgctgaccccgatgaacgcaggcaacgtaaacagccatattcttttcggcatgaccggcagaagcgtgacaacgacagtcggaaacggaaaagtcctgatgaaagacagaattcttacgaatattgatgaagagaaagtcatggctgactgcaggcaggcggcgaaggaactggctgaccgaatcaatagtagatagagggaaattttgacgtgggagtgagggtggctgacggttacgtcctttctgcgggagacgaaattttatataaatctaaagcatgatttaataaaatttgttcccgcagaaaggactgtgtacgggcaggctggagactctcctcgcaaaagttgctggtggaatagaggggctggccgatgggattggcggaataaatgcagaaaatgcaggtagaagattccagagagaaagtcttttgtttgatgtaaaatgaaggcagcaattgtaatgtgaaagagtttttatgatacagagttttgaagtaatgaaatatggtaataaagcaacaggaaagaaatataaataagcagcaaagataaaaagcagcaaagataaaaagcagcaaagataaataagcagcaatcacaataccaataaagcagaaagaaaatattagaaaattcacagcgaggtgttttcttttttcagcggcatccagggaagcagcggggtttggagggaaacaaattttattaaatcatgctttagatttatataaaatttcgtcttccctccaaaaaccgcggacccggcagccaacaaattcaaaaaaagataaatcacccgcaaatcaggaggttaatgatgggagacagaatgacaccaatgccatttccgcagttagtggagtgggtaatgaaggaacatgacgataaggggactgtgtttggggtttacagaccttatcaggcgaaggcggagaatgacaggaaaatctttggaaggactctggagactccggttggtccggcggcgggccctcatacccagctgacccagaatattgcagcggcttactatgcgggaagccggttctttgagcttaagacggttcagatcatcgacggcgaggatcttccggtgagtaagccctgtatcaaggctgatgatgagtgctataactgtgagtggtcaacggagctttacgttccgcaggcacaggaagagtacataaaggcatggtttttactgagcgttatggcgaaagagtatggactcggcgccatggacggattccagttcaatatgagcgtgggatacgatctggagggaatcaagtctccgaagattgatttgtttatcgagtccatgaaggacgcaaaggatacggagacctataagaactgcagggagtatctgctggagaacgtttccatgtttaagcatgtgacgaaggaggatattgaagggatttcttctaatatctgtaattccgttacactctccacgctgcatggatgcccgcctcaggagatcgagcggatcgctacgtatttgatcgaggtgaaaggacttcatacctttatcaagtgcaatccgacacttctgggatatgaatttgcaagaaagaccatggatgagatgggatacgattacgtcgctttcggcgatttccatttcctcgatgatttacagtataatgacgcgattccgatgcttcagaggcttaaaaagctggccggagataagaatctggagtttggcgtgaagatcaccaatacgttcccggttgatgtgaagcagaatgaacttccaagcgaagagatgtacatgtcaggaaaatcgttgtatccgctgtctatttcactggctgcgaagctggcgaaggagtttgacggacagttaagaatctcttactcgggcggtgcagattaccataatatcaagagcattgtagatgcgggaatctggccggtaacggtggcgacaaccctgttaaagccgggcggatatcagagactggatcagatggcgattgaactggaatgtggaagcgtggagtttgccggagtgaatgcagagaaggccgcgaagctggcggaagctgcgattacggacgaacaccatgtaaaggcggtaaagccgcttccatccagaaagatgaacaaaccggttccgcttatcgactgctatgtggcgccgtgtaaggaaggatgtccgatccaccaggatgtgaccacgtatttacagctttccggagcaggcaggtatgaggaagccatgaaggtgatcgcagagaagaacccgcttccatttattacgggtaccatctgtgcacataactgtatgagcaaatgtaaccgtaacttctatgaggatccggtcaacatccgcggcgtcaagctggtgtgtgcggaaggcggctacgacgctctgatgaaggaaatcaaggctggggagttaaaaggaaagaagactgctgttgtaggcggcggcccggctggtctggcggctgcgtatttcctgacaaagaacggctgtccggcgacgatctatgaggcgggcgacagccttggcggcgtagtaaagcacgtaattccgggattccgtatttcggatgaagcgattgcaaaggatgtggctctggctacggcttacggcgcagaggtgaagctgaacacgagagtggagagtctggaagacttaaagaaggccggatatgactacatcattctggcgactggcgcttcaacgccgggagttttaaaactggaagcaggagaggctatgaacgcactcgatttcctggcacagtttaaggccactgacggaaatgtaaatatcggcaaaaatgtcgttgtcatcggcggcggaaataccgcgatggatacggccagagccgtaaagaaaacaaaaggggtggaacactcctatctggtatacagaagaacgaaacgcttcatgccggccgacgaggaagaactcgtaatggcagtggaagacggtgtggagttcaaagaactcttatctcctgtgaagctggaaaatggaaagctgatctgcagtgtgatgaagctgtctgattacgatgcttccggcagaagaggcgtgtccgagacaggtgagacggtggaaattccggcggataccgtgattgcagctgtcggcgagcaggttccgaccgatttcttaaaggccaacggaatcaatgtgaacgacagaggaagagccatggtaaacgaggagacactggagaccagcgtatccggcgtttatgcaatcggtgacggtttatacggaccaaagacagttgtagaagctatgcgtgacgccagaatggcggcggaggcaatcctcggtgcaaaggcggcaagagactttgatgatacggtggaggatcttggaaaactctacgacagacgcggagtgctggctgaaacgaaggaatataaggaagacagcacacgctgcctcggctgctccaatatctgcgagaactgtgcagaggtatgtccgaaccgtgccaacatcgcgattcatgtacctggaatggcgaaacaccagattatccatgtggattatatgtgtaatgagtgcggtaactgtaagagcttctgtccatacgacagcgctccgtacttagataaatttaccctgtttgccaatgaagcggacatggaaaacagtaagaatcagggctttgttgtcctcgatcaggctgcggtttcctgtaaggtgcgttatcttggaaacatgtatacttggaatgccgcggacagcgacagcgtaattccggaaggcttgcgcaaagtaatggaaactgtctgcaaagattatgattacctattagcatagggaaagcaggtgaacttatgtataccttactggtgaatggaacgagcgttaccgtggaagaggaccggaagctgatcgatgtgctgagaaatgacctgggactcaaatctgtcaaggatggctgcagcgaaggcgcctgcggaacgtgtacggttctgattgatggaaaggccaccaaggcctgtgtccagaaggtttcaaagatggaaggaaaatccatcgtaacagtagaaggactcagtgacagagaaaaagaagtatttgtctatgcctttggagaagcgggagccgtgcagtgcggcttctgcatccccggcatggttatgtgcgcaaagggactgatcgaccagaacccggatccgacccgcgatgaggcggccttcgcaatccgcggcaatatctgccgctgtacaggatataagaaaatcatcgatgcgattctgctggcggcaaagctgttccgtgaggacgcaaaggatttaaaagccccggtggtagatcatatcggacagcgcgcgcatcgtgtggatgtgccggaaaaggtgctcggttacggggagtacgtggatgatatggaagtggagggtatgatttacggaagtgccatccgcacaccgtatccgagggcaagggtcctgtccatcgataaatccgaagcgcttgcgctgccgggagtccgtgcggtcctaaccgccgatgacgttccgggaggcaataaagtaggtcatttaaagaaggactgggacaccatgattccggtgggtgagattacccgttacgtgggagatgcggtctgcctggtggcggccgatacgccggagattctggaagaagccaaaaagctggtgaaaatcgaatatgaggagctgccgggggtattcagcccgcaggaagctttaaaaccggatgcgccgctggttcatgagacaggcaacgtgctggctcacgagcacctggtgcggggcgacgcgaagaaggccatcgagaactccaaatatgtggtgacaaaggaataccgcactccatttacagagcatgcgttcctggagccggaatgctccgttgctatcgtagacagggagaaggaagaggctctgatctattcatccgaccagggaacgtatgatacgcagcgcgaatgcgccggaatgctgggctgggagctttccagggtccatgtcattaacaaactggtgggcggcggcttcggcggtaaagaagatatggcggtacagcatcatgcggcccttctcgcttaccatacggggaagccggtcaaggtgaggctgacgagaaaagaaagcattatgattcatccgaaacgccatccggcgtggatggaattcaccacagcctgtgatgagaacggatatttaaccggcatggcggcaaaggtgatcacggataccggcgcttacgcttccctgggaggaccggtgcttcagaggctctgtacccatgcggcaggcccctataactatcagaacatcgacatcgacggcaccgccgtctatacgaataatccgcctgcaggtgcgttccgcggcttcggcgtaacccagagctgctttgctacggagtgcaacttaaatctcctggcggagatggtggggattaccccgtgggaaatccgctaccgcaacgccatacggccgggtcaggagcttcccaacggccagatcgcctctccgggcacagcccttgcagagacgctggaggcggtgaaagaaatctacgacagccacccgtatgtgggaatcggctgtgccatgaagaatgccggcgtcggcgtcggtatcccggactggggccgctgccgcatgaccatcgaggacggaaaggttcatgtccgctccggtgcatcgtgtatcggtcagggactgggaaccgtgctggagcaggtggtctgtgaggcgctgggcgtcacgggagaccgtgtggtctatgtggcagctgagacgaacctggcacccgattccggtacgacctccggttcccgccagaccctggtgacaggcgaggcggccagaagagcctgtatggatattctggaagatttaaagggcggaaagaccctggaggatttgaatggaaaagagtattacggcgaatacttagccgctactgatcctatgggatgcggcaagaagaatccggtatcccacgtggcctacggctacgcgacccaggtggtgtgcctgaatgaagacggcaccattgaaaaagtggttgcggcccatgacgtcggaaaagccattaacccgctgtccgtagaagggcagatcgagggcggtgtagtgatgtccctgggatacgccctgacagaggatttcccattggatcacggaaaacctctggcaaagttcggtacgctcggcttattccgcgcggataagactccgcctgttgagagcatcattgtagaagaaaacaaggatccgctggcatacggagcagtgggaatcggagaaatcacctccatcccaacggcaccggcagtccagggcgcctactacaaactcgacggaaaattccgtacgtcactgcctctggaagacacagcatacagaaagagtaaaaagtaaaaagaaaaaccttgataagggcgcagagggccgagcagtatggtcctgcgcccttaaagtaaaaatacgtttctccgcctgaaacggttgtatgcaaaagaaaaataaggtatactgaaaataagttatttcagtgaacattcacagaaacttatgcagtgttgtgcttatgcatgcgagcggagaatggaggccgtcatgttcagagaattgagaagaaagaatcagcagttatcggaaacggaagccaggagtattttgaagaacggaacccatggagtgctgtctgtccagggagacgacggttatccgtatggtgttccgatgaattatgtgtacggagacgacgcaatctatttccactgtgcaaaggaaggccataagatggagggctttcggcgctccgataaggtttccttctgtgttgtgggagaagatgaggtgataccggaagcattttcgaccgcttataccagcgtgatcgcgtttggcagagccgtgattgtggcggatgagaaagagaagcgggaggccttaaagcttctggcggaacgattttccccggagttcggggaggagggcgaggctgcgatccgcagcagctggaatgatgtctgcatcgttaggctgaatatcgaacacgcggtgggaaaagccggcagggagcggattaagcgggaggaagcccgatacgcttctttcctgtaacagcaagcagaaaggaaggaattgtcccatgaaaaaagtattaaaaggcggtaccgtggtatcgggggaaggctgtaaaaaagctgacgttctggtagaggatgggaagatcggagccgtggctccggagattacggacgaggaagcggaagtggtcgatgtgtcggggaagcttttatttcccggatttatcgatgctcatacccatttcgatctgcatgtatcgggaacggtcactgcggataattttgagactggaacgaaggcggccttatccggcggcacaaccatgattattgacttcgcaacgcagtacaagggagaaagcttacataaggctctggagcactggcatgaaaaggccgacggcaacgcctcctgtgactacggcttccatctggccatatccgactggaatgccgggatcagcgaggagctccagcagatcgtggacgagggagtgacttcctttaagatctatatgacctatgacgacatggtgctggatgacaaatccatctaccaggttttaaagcggctgaaggaggtcggcggaatcgccggcgttcactgcgaaaacaagggaatcatcgaagctttgacagaggaagagaaggcgaaaggccacctcaccaccgacgcacatccgaagacgagaccggccgtggtggaggcggaggcgatcagccgtctgctcaagatcgcggatctggtacatacgccggttatcatcgtgcacttaagctcgggagccggttatcaggaagtgaagtatgcaagggaacggggccaggaggtgattctggagacgtgtccgcagtacctcgttctgaatgaaagcgtatacagcttaccggattttgagggaagcaagtacgtgatcgctcctaccatcaagaaggagacagacagcacaaggctgtggaacgccatcagaaaagaccatattcagacgatttcaaccgatcactgcagcttcaccaccggccagaaggcggcgggaaaagacgactttacgaagatcccctgcggcatgcccggagtggagtcgagaccggctctgatctacagcttcggcgttttggaacgcgatttgaagctggagcagatgtgccgtctgctctccgagaacccggcgaagctttacggggtatacccgcagaagggagccatcgctcccggaagtgacgcggatatcgtcgtctggaacccggataccgaatggaccatgtccgtggagaatcaggttgccaatgtggactactgtccatttgagggcacgaaggtgaagggaaaggcggagcaggtttacttgaaaggcgaactggccgccagggacggaaacgtggtactggagaagaagggaagctacgttccgagacagcgccggatggaactggattagggaatcgaaaggaaaaaagtatgatagcttacagttgggaacatgacggacttcgggagcgccccactctgtgggaggcgttaaagctttccacggaacgccacagggtgattgccctgaccggcggaggcggaaagacgagcgtcatgttccggctggcggacgaactggcggatatgggaaagacggtcattgtgacgacgacgacccatatctttaacccgccggaccggaacgtggtggagactgactgcgcagaggacgcggcgaagcggttggagagaaatggttcagtccttgtggccggtgttcctgcggccggcggtaagcttaaaagcctgcccttagcggaggctgccaggctgaaggagctggccgacgtcctgctgtatgaagcggatggggcgaagcggcttcccataaaggttccaaaggacggagagcctgtgatactggagtgcaccgacgttgttatcggctgtatgggactggactgcatcggcggtgagctggaggaattctgtttccgcacagaacaggctgccgaactgctgggtctgcagaaaggaccggatggacattacagccaccggatcacatgcggcgacgcggcgaagattctcaccagtgaatccggtacgagaaagctggtgggagaaagagactaccgggtagtgatgaacaaggcggatcaggaggaactcttagcgaaggcggccaggatagcggaagatatggaacggctgcatccggtaccgtgcgcggtgtcctgttttctgcgcggggaccatttgtagcagaagagaaaggcggcgaagatggagcaggagaaaatactgcgtttccatatgaaactcaggctttactatgaggaacggaactttggaccgggagtcgcgggcctgatgcagcttgtgcgggaacgcggttccttatcggccgcgtgccaggagatgcatatggcgtattccaaggcctggaagatcatacataaggcggaggaggacttaggctttccgcttatggaaggaaaacgcggcggtgaaaatggcggaaccacggttttgaccgaagagggagaagcgtttttaaataagtatttacagtttgtgaacgaagcagaaaatgcggttgcggagttgtttgaaaagtattacagctagtaccgccggacctaaatacgtactgcatagcacccgctatctacgccaggagcacgcccacgaagctagtcgtagggtccactacgccgtcgcttcgcggacgcacacctgacgcagatatcacgcactatgcagtacgcatttaagtccggcggcactagtacagcgttgcataagttccagtgaatgctgtactagacaggaggatggggacgggcaatcacccattttaattttatcagggatattctcacttgagaatatcgacgcaaatggatgggctgcctgtaatgataaagtgaggtaaaaaaattgggttataaatcaagattaaaaaatcaaggataaaggagcaggagtcatgagggaaatcaggacagaagatgcggttggccacgtactgtgccacgacattacgcagatcatccctggggtgatcaaagatgcgaggtttaagaagggccatgtggtgacggaggaggatattccggtgctgctctcgctgggcaaggagcatttatacgtctgggaaaaggacgagtcgaaataccatgaaaatgaggcggccgagattctttgcggcctgtgcagaggcgattatatggaacgaagcggagtgaaggaaggaaagattgaactgacctccacggtccgcgggcttcttaagatagatacagaactgctggacagaatcaacggactgggggagatgatgatcgcttccaggcacaacaacactccggtagagccgggagacaagctgtgcggaacccggattataccgcttgtcatcgaaaaagagaagatggaggaggccgtggaggtctgcggcggaaagaagatatttaccatacttccgtatcagaacaagaaggtgggaatcgtgacgacgggaagtgaagtctatcacggacggatcaaagacgcgttcggcactgtcctgaaggaaaaggtgaaggaattcggcggggaagtgatgggacagacgatcacggatgacaatccggagcatacgaggaaggcgatcctggaatttatcgcacagggagccgacatggtattggtgagcggcggaatgagcgtggatcctgacgataagacgccactcgctatccgcagcactggagcgcgtgtcgtatcgtacggagcgcctgtgcttccgggcgccatgttcctgcttgcctactatgaaaaggatggccgccagataccggtggcaggccttccaggctgcgtcatgtacgccaggcgcacggtgtttgacctggtgctgccgcgcctcatggcggatgatcccgtgacgaagacagagctggacaaactgggaagaggcggactctgcctgtcctgcgaggtctgtcattatcccaactgcggatttggaaagggctggtaagatggaaggactgacacattttgatgaacacggcaacgcccgcatggtggacgttggagagaaggccgtgacggacagaatcgcaactgcgcatggctttattcacgtaaaccgtgaggtctatgaggctataaaacagggaacagccaaaaaaggggacgtgctgggcgtggcgcgcgtggccggaatcatgggggtgaagagaacttctgatcttataccgctctgccacgtgctgatgctgacgaagtgtacggtggattttattctccatgatgacaggatggcggtggaagccgtctgtaccgtaaagaccagcggaaagaccggcgtggagatggaagccctgaccggtgtaaatgtggctctgctcacaatctacgacatgtgcaaggccatggaccggggcatgaccatgacggatatcactctcctgctgaaggatggcggcaagagcggcctctaccggaaagacggagagagcctatgagagacggcaatggaagaaagatcgattatatccgcatttccgtgacggaccggtgcaatttgcgctgccgctactgtatgccggaggaaggcatcgacttaatgcgccacgaagacattctcacctaccaggagattttaaagatcgcagagactggggcaagactcgggatcagacgcgtgaaggtgactggtggggagccgctggtgagaaagggcgtctcccagctgatccgggaactgaatgcgatcgagggaatggaggacgtgacgttgaccacgaacggccttctgctgggggacatggctccggagcttgcggaggcagggctctccagcgtcaatgtcagcctggatacgctggatccggaacgcttcagccagattaccaggcgggaccggttcgcggatgtcatgaaagggattgaatccgctgtcaggagcggactgaaggtgaagataaactgtgcggtgatggagcatttgagcagtgaggatgtgctcgccttcgccgaatattcggtgaaaagcgggattcctgtccgttttatcgagatgatgcccatcggacagggaagaaagtaccacgccatggataatgaggagctgctcaaaatcctttctgaggaatacggcgatttaagggaaagcacggagccgaggggaaatgggccggcggtctattacacctatgcatcgggagcgggctgtatcggactgatcagcgccgttcaccataaattctgcggaagctgcaaccgggtgagactgacgtcggatgggtttttaaagctctgcctcgacagtccggccggagtcgatttgcggacaccgctgcgcagcggcgtatccgatgaggaattaagaggcctgatggaacagtggatcagagtgaagccggaaagccatcacttcctttcatcggagggatgtgagggagaactgccgctttccgacggtacaacggaaaaatgtttaaatatgaatcaaatcggaggataaaaacatgggtcaggttatggctgtctgcatcagcgagaaaaaagggacacagaaaaagggaatttcagagggacattttatagaggaatttggcattgaaaatgatgcacatgcgggaaaatggcaccgccaggtgagtctgctgtcctatgagaccatcgaggcatttaaggagcggggagccgagatcggcgacggcgccttcggtgaaaatgtgattgtgaaggggatcgatctggtccgccttcccgtgggaacgaggctgtcctgcggtgatatccttctggaggtgacgcagattggcaaggagtgccacagccactgcgagattttcaagaagatgggggaatgcattatgcctgccaacggaatttttacccgggtgctgcacggaggcgtgatgaaggaaggggatgaaataaacgtatgtacagagcaggaatcgtaacgctcagcgataaaggcgcggcaggcgagagagaagataagagcggagccgtgataaaggaaattctggagtcagcgggctatgaggtggttagccggagtctgcttccggatgagggagaggcgctgaagacagagctcatccgcctgagtgaccaggtgcagtgtgatctggtgctgacgacgggcggaaccggattttccaggcgggatgtgacgccggaggccacgatggcggtagcagagcggaatgctccgggaatcgcggaggcgattcgtgcctacagcatgaccgtgacgaaacgcgccatgctgagccgcggtgtgagcgtcatccgcggaggcacgctgattatcaatcttccgggaagcccgaaggcggtccgggagagcctggaatacgtgctggatacgctgccgcatggtttggacatcctgtcgggacgcggcggagagtgcgccaggaagtagaaagagattgattgaaaggaagagagtgttgtggaaaaagtattgataaaaggggcgggagatctggcaacgggaatcgcctgccggctgcatcgctgtggattttccgtggcgatgaccgaaattgcggttcccacaaccgtgcggagaacggtcgcattttcccgggcggtttatgaaggaaatgccctggtggaagatattgaaggggtgctttgccggaatacggaggaaatagatcacactgtgaatcaggacaaggtggcggtaatcgtcgatccgtcgtgtgagacgttaaaatcctggagaccggatatcgtggtggacgctatcttagccaaggtgaatctgggatcaaaaatgtcggatgcggatattgttatcggtgtcggccccggatttacggctggtgaggactgtcacgtggtggtggagacgaaacgcggccacaatctgggacgctgtatctgggaaggcagtgcatttccgaatacgggtgtccccggaatgatcggaggatacgataaggagcgcatcattcgcgctgcttctgacggtatatttacgggagctgtggagatcggaacgctggttaaaaagggcggcgtggtaggacacagcggaggaactcccatatatgcagaggtgggaggcgttgtacgagggctgcttcaggacggtgtggcagtgacaaagggaatgaaatcgggagatattgatccaaggggtgtcatcgaacactgctggaccatttccgataaggcaaccgccataggaggcggagtgctggaaggtatcttttatataaagaagaaaaggagagtaaagtaatgaaaaaagcaatcttattagcaggtgcattaacagtggcgatggcggcgcttaccgcgtgcggaggaacaggaaaggctgaaccggagacgacaacacaggcagctgcagaggcagccacaaaagcagagacagagaccacagcgaaagcggaagagaccacggaggcagcggaaaaagcggaggcacagaccgtgaccatcgcagcggcagcaagcctggaaacctgtttgagagatgaactgattccattatttgaaaagcagaaccctggttttacaatcgagggaacgtatgacagttcaggaaaactccagacccagatcgaagagggggccggtatcgacgtattcttttcggcggcgacgaaacagatggatgctttaaacgacgaaggcatgattcaggacggaagcgtcaggaatcttctggaaaacaagattgttttcatcgtaccgaccggtgacgaaggaaactactcctctttcgaggatatcgcaaaggccgaaaacgtagcgctcggagatccggacagcgtgccggtaggccagtattcgaaggaagcgctgaccaacctgggactctgggatgaggtgcttgcaaaggccagtctgggaacgaacgtaaccgaggttttaaactgggttgcagagggaagtgcaaaggccggaatcgtatatgcaacagacgcagcgcagaccgataaagtaacgatcgtggcagaagcaccggaaggaagcgttaagaaggcgatttatccggcaggcatcatcaaagactgtgaaaatccggatggcgcacagaaatttatcgatttcctggccagcagcgaagctatggatatctttgtaaagaacggattcgcagcggcagaataaaacgccgggtaatgtgccagagataaggaggagaagtaagtggatttgtcaccggttctcatttcactaaaaacatcagtcatatcgattattttcacattttttctggggatatgggcggccagagcggtgattgccctgaaatcagaacgggcaaaggctatactggacggagtactcacacttcctctcgttctgcctccgacggtggccgggttctttctgctttacatatttggagtgaagcgcccgatcggaaagctgcttcttgctgtattcagctataaaatcgtgtttacctggcaggcaacggtgcttgcggcggtggtgatatcatttccgcttatgtaccgttctgcaaggggcgcgttcgaactggtcgatgagaatgtcttaaacgcggcgagaaccctggggataccggagcggaaggttttctggaagattcttatgcctatggccatgccgggagttctctcgggcggtgttctggcctttgccagaggactgggagaatttggagcgacggccatgatcgccggaaatatcgcgggaaagacgcggacgctgccccttgccatctattcagaggtggcggcgggagacatggagggagcggggaaatacgtgatcattatcgttgccatatcccttctcatcgtggcaggcatgaatgtggccgccacaggcaaaaagaaattttcgtaggagtgagccatgagcctgaaggtagagatcaagaaaaaattgagggatatgactttaaatgtcgccttcgacacggagagagattccggaatcacagggatcttaggcgcctcgggatgcggcaagagcatgaccttaaagtgcatcgcgggaatcttcacaccggacgagggaagaatcgagttaaatggccgtgtgctgtttgattcggcaaaagggatcaacgtaaaaattcaggacaggggagtcggttatctgtttcagaactatgcattgttcccccacatgaccatacgggaaaatgtggagatggccctgtcctgccctaagtcagagcggcatgaagccgccatgcggtatctggacatgtatcatatcggcgaactggcggaccggtatccttccagactatcgggcggccagcagcagagagccgccctggccaggattatggcatcaaagccggaggtgctgatgctggacgaaccattttccgctctggattactatctgaaagagaagcttcagctggaacagctggaggaactgagaaactatgacggtgacgtgctccttgtcacgcacagcagagatgagatctatcgtttctgcagtacaatccacgtgatcaacgagggtgaaattgtggtgtcgggggccgtaaaggatgtctttaaagagcctgagaccgtgtcggcggccaagctgaccggatgtaagaacattctggatattaaatatgtggctgcccacacattttacgtgccaaattgggatattcaggttataataagagacagggaagtcccaaaggatacgccgtttatcggaatacgcgcccattactttaccgccgcccatgagtcggaaaaggaaaatgtgatggagtgccgcctgaagcagattctggatgacccctttgaggttacacttattctggaaaatgatctctggtggaagataccgaaagggcgctggaaggatgatatgaaggagcaggtgccggagcgcctggtagttccggaggagagcattttctttttaaaggacaggtagaatggaggatttggcagatgaaactgactcttatactgctggcagcaggaaacagcaggcggtttgatggaaacaagctgcttaccccgtttcacgggaagccaatgtatcagtatatcgtggaggaggtggaaaaactgccggatggccttttcgatgataaaatcgtagtaacacagtatctggagatcatggaagacctggaaaaaagagggtatgtggtggtagagaacgtacagagcagtctgggaatctctcattcgatccacctggccctggaagccgcggcatcaccggacggtgaagaagcctcgtactgcttcgcggtctgtgaccagccgtatctgaaggcggccaccatagagggcctgatcgaaggctggagaaacagcaaaagaggaatcggttgtctgtgcaatatgggtgagttcggaaaccccgcgattttttcggaagcatacaggaatgagcttctggcgctggaaggcgatgtgggaggaaaacgggttctgcgcaggcatatagacgacctctatctgcatgaagtggatgatggcctggagcttgtggatatcgatgtgagaggctgagccgtctgtaataaaatggaatatgatgaaagagtgaggcgtgggatttcagaactggaaattccacgcctgttattttggggtttccggttcgggcagtaccagagtgcccagggggacgcggttacatagagcttcgctcatgcgcaagcaattctgccggctgccggaaccagaatggtattgacaaatgacacctctgtccctaaactgaaattagaaaacaagtggcaggtataagtaagggggcatgattgatggaacgggaacagcttatgacggaactgagaaaaaaagaagattcgaaggtgtatgcggagctgggataccgtgacgactcggtgattccgcttcttattgagattatggaaacggagaaaacggccgttaagtatcaggcggagaaggcggtgcggaaaatcagcgaagagcgcccggccatgcttcttccatatggggaccgcttaatcgggctattggacagcgagaataattttataaagtggggaatgcttcttacgcttccggggcttttggaagccggaggcagggacatctgggggaaaatgagagagaagtatctcctctcgttccggtcgcagcaggttgcggaattcggcaatgcggtctcgtgtgtcgggaagcttctgaaggtctgtccggaagaggaaacgacgatcattccccttcttttgaatatagacggtcatacgtttctccatcacggtgtgccgtctccggaatgccggaatgttgcaaagggacatattctggaatgctttctggaacaattcccaggttctgcctatagagaggaaatggcagccttcgcagaatgtaacctggaaaatgacagaaaacaggtgtgtgccagggcgcggcgtcttatgaagctacggggtttttgacttgcctgcccaggaatcagcggcctttgcatccgcttcgcagggaacatcagggagtatcgcacgcgcggcttcttccatcgtattttttaacagaacaaccgcatcgtccacttcctcctccgggacttccatcaggatttcgtcgtggacgatgcctacgattttcttgtcactttcccggatccgggaggccagaaggccgagggcatgcttcagaatatcggcggccgtgccctgaaccggagtgttagccagatcggccagacctgtgtccggggaaaacaggaacttgcgtcctgtgagcgttcggccttccaggggatggctctctcttaagtcatggtgccaccagttgatcccatggtaattctgaaagaaggcactgcgaaactgttctgcttcttctaaagtcatgtctacgccataggactgactcgagtacagtctgagtccttccgcgcccataccgaatatcagaccgaaattcacagcctttgcggcctgacgctgcgcttttgttacctgactgatcggaacattggaaatcagggaggcggtgagggcatggagatcctcgcctttctgacaggcacttttcattctggagtcaccggaaatctgtgccgctacgcgcagctcgatctgggagtaatcggcaagaaccagttttcttccatggggtgctgtaaagcagccgcgaaaatcggcttcccgcggaatctgctgaatattgggattgtaacagctcattcttccgctccaggcgccgatctgcatgtatttcggatggagccggccagtcacgggatgaatctgggccggaatgggatggaggaaggaagagagggatttggagtgccttctgtattcggtcagcgcctgtaccaaaggctggttatggtagggagccaggcttcttcgcgatgtggagttgaccgggattccgtaccggttcagtagtttgagcacatagggattgctctcaaagtttacgtccagggcttcctcaccgccccacagggtcagctggtacgtgggagtgccgctgtaggtgtagagggtctccagagcatcgttatactgtttctcggtcttcctgcgcagcgaatcccactgttccagatcgagattgattccgtcatattctgtatgggcgatggcggaagcgcaggcaaactcaatggaggcaatccggtcgagaccgtgatgagccaggagcggcttcatcacaccgtacagcttcagcagaatccctgcatccaacgcggcataggccagctgggatccggtcagagaggtgctgtcccagggccctgtctgctctgtcttatccatcctgatgccgagatagtggtccgccaccgccgccaagcccgcccgcaaaggaccgccgcatggccggagcaattgagcggccagcatggtatcgaagactggaaagcattcgattccaatccccatgagaaactgtaagtcaaacttggcattgtggaacagcttttccgaaggggtgtccagaagctctcttaagcaggaaattccatcagggagaaataccgcacagtcaaagacaagcacaggaataccaggagcgcttatctggatcagacggagccggtcgcggtgcgggtcgagcccggttgtctctgtgtctatggcgaggagcggcgcttcttttattgccttctggtagggaagcgtgtcggagggggaagagataaccaggtagtcaatggataatccggaattgtctgtcggcgtggcctggggtggtgtgattttattttccattgacggctcctctctgttttgttaaaatagaacgtacgttctcacttcttccagtatactatattgtgggcggaaatgcaattgataatgcggtattttactatattaggactgtgaacggtaaccgatggaaaaaaatacaaatgcagaaagcctggatataaggtaaaatagacaaagtttaaaaaggcagatcaaattcgcttacaaaaatataattttaaagataaaatggaagaagaaaggcagtattgaacgaaacagatttggagaaaatgatcagacgtaaaagaatcagacagagtaggacattatatagaatgatcatagggaaaggaccggatacagattaatgaagagcagagagtacaatctggcgccagaagagaaaatggccagggaacagatgatggaactgattttgatatccagccgttttacaagcagcatcacggttgaaaatgaagagaaacattttaatggaaagagcatactgaaggcgggagagctgaaaaagggagagcgtttttatgtggtggcagacggcagtgacgctaaggaggcgatcgaggcgcttgaccggttatttccgtgtgcagtgaaccagccggacgtgcagtcctgtccatcgaaaaagatgcagaaacgaaggtgataagaaagcgttaaggaatgcggacgcttcttgacaatgacgctggggttctttataatttctttcatattaccgctttatgcagaaaggaatttactgatttcatggacgacgccgacagtgacgctgaatctgacacacaccgggcaaactcaaatacgacagttacataccggttgataaaaaagaacatgataattaaaatgaaatgttgacataggagcataacctgcgtttccttcgggaaaggcgggctatgcttttttgcgtagtagaaaagcattctttggctgcaaaagcagccgcgccctggtgtgtgagtccgtcaaggcggactctatgtgtcaaaaaagaagaaagaggaaggaaaaatttatggaagaacagagtatctcattgattattattattggatgtatcattatgtccgcgtatttctcggcgacggagacggcattttcctcgctgaaccggattcggatcaagaatatggcggaaaagggtaataagagggcagggctggtgttaaagctgtccgaaaactatgacgggatgctgtccacgatcctgatcgggaataacatcgtcaacattgcaagtgcgtcgctggctacggtcatatttgtgaagctcctgggcgatgaggcaggcgccagtatatcaaccgtggtgacgacgatcgtggtgctgatcttcggtgaggtttccccgaagagtattgccaaggagtccccggagcagtttgccatgttctccgccccgtttttaaatgcgtttatggtgctgctgacacccgctaattacttatttaaacagtggaaaaagctgctgtcagtcctgatccggacttcgggagattccggcattacggaggaggagctgcttgccatcgtggaggaggcgaaacaggatggcgggattgatgaacaggaaggaagcctgatcaagagcgccattgaatttacagagctggaagccatggatatcgcaaccccgcgtgtcgatgtgacaggaattcccgtcgatgcggataaagaggagatagcggcggtgtttggcgagaccggatactcccgtctccccgtctataaggataagatcgacgacattatcgggatcatttaccagaaggacttttataatcaggtgtatcgcggtgtatgtagcgttgaagccattgtccgaccggcgctgtatgtggcgaagagtaagaaaatcaatgtcctcctgaaggaacttcagaaaaataagatgcatattgcggtggtaatcgatgagtttggaggaaccatgggcattgtaactctggaagatattctggaggagctggtgggggaaatctgggatgaacacgatgtggtggttcaggaaattgagaagatatctgatcaggaatacctggttttaggcaataccagcgtggaaaagctgtttgaggagctgggcggtgaggaagagtttgaatcgtttaccgtaagcggatgggtgatggagctggcggagcggataccggaagaaggggatgtgctctattatgaaaatatgaccataactgtcatgaagatgaaagacaggagggtggagcaggtgaggatcgtgctggaggcagaagtcatggaaccgtgcgcagcctcgttttaaaaccgcgtacgaaagtcccgcttctgtgtcctgcacaaagtcctcgcaaaaaacagatagaaaactctctgccctcgtgctataatgaaaataataaaatttgaacgaaccaaaaacgaggtgcagcctatgccaacgatcaaagatattgccgccaaagcaggggtatcccacggcacagtttccaatgtgttgaacaagaggggaaacgtcagcgccgaaaaaatccagctggtggagcggattgccaaagagatgggatataaaatgaatgtccaggcccagcagctgcgggccggtacggcacggagagtctgcgtcattgtgcctaagatcagcttaaaatgctacaacgatttatataacgggctggaacagtacctgcgggagtacgagatcagcatagaactcatatccaccaataacctggagtgcgacgaggaaaaagcggtaaagaaggctctctccttaaatcccatggcggtggtggtggtcagctcgcttcttaagaacaggggattatacacttcagataccaggtttttctttgccgaaagaaaggtaaagggaatgccggacgcgtctgtctacgtatcctttggatttgagcaggcgggacgggatatcgcggttaagtgtatcgaggatggccatcagaatgtggctttgctctgtgagaacagcatctattccaacaataaaagctttattaacggtgtggtggatgtgttggaggacgataattgctcctgcaaaatatttcccagcgatgacagcatgtggtttaacaaggcctttgatatcctgggatcgaaagaggattttgacgcggtgattgccatgagccaggaggacgccgattatttgagggtggcccatcagtataatccggataagaaaatgccggttatatatgcgctgaccagcaagagcatcggaatcgatccggccgtgtgcagatatgagctgaattataagctgatgggaaggaacatagcggagcagatcgtaaatgccggcggggaagaggcggagacggcgcctgcgcagaaacagcagatcatcatggaaaatgacggattctacgataatccccttccggccgctgggaagaaagacagcatctgttttttgaccattcagaatctgaccagcaaggccatcggcatgctgcttccttcctttaccagggagaccggtatcaaggtcaatatgatcgaggtttcctacgatgagcattacaagatggcgcaggcctgcgtgcagaacagcccctatgatctggtccgcatagatatggcgtggatgacggagctgggcgataagatttatcagcccttcgacagctccagttcttcggtcaggtggctgcggcagcagattcttccctcactctcggaaaactattccatggttcatggtgtccagtacgcgtttccgttggatgcctgcgtgcagatgctgttctaccggaaggatctattcgaggatgagttgatcaagagggaattttttgaaaaatacaaacggcgtctggagattcctaagacgtttgaagaatacaatgaagtggccagattttttacgagaaaagagaatcccgattccaggacgaggtatggagccgttaccgcttatggaagaacattcctggcggcgtgcgattttctgccgcgttttagggaactgaagaaggatatcttcgatgcacggggaaatgtaaatatcctgatccccgagatgaaacaggcgatccgcaattatctggatacctgcaagtatgcgggcagtgatatctatcagtggtggggggaacccacccgccagttctcggaggggaatacggcgatgcatatcgtgttttccaactatgcctccgagatgatacacaatccggaatcgaaggtgctggggcgaatcgcctgcgacaccgttccgggcgggcagccattgtcgggcggaggctcggtgggaatctccagattcagcaaaaagtatgacgcgtgcatgagcttcttaaagtggctgtaccggaaggatatcgcggagaccatcacgtatcttggcggatacgtctgcaaccgccagatcagcaggaacatggatatcctggaacgctatccgtggctcgagaacatggaaaaatccttcgaacccggctggaggctttataaacatgacagaaatcctgatttcaatgaatttctgtttgaggatatcctgggtaaggcgatccggtccatcgcatcgggaatcgaagagatggatgacgcgctggagaaggcgcaggaggaatgtgatcgggcatttaacgaaacaagcgggaattcttccatctcaataggcggagggctgaatcgccaaaaacaagtttagcggtagtggcgggcggagagaaatcggtataccacattgacatgaagtcaaactgcgcatcgatataagaggtagccgcactctgcgaaattacggagcatggataaaaagaaataaccggcagcaatggaaataaaaagtatggaaggcgccgcgcaataagttttaggtaagcaataagacacctgaaatttgttgcgcgacgttttttttatgcttttatgaggcaaggatagactttcgttaaaaggtgaaagctaagcagaaataaaaacttttaaagtcgaatgtaacacagaaaacagatgtattaatttgaacgtgccaaataaaatgaggttttaaactgcgaaaaacaaaaggtaacataataaaatgcacaaaaaaatgtaaaatctatgttataactatgtaaaataaacaaaataatttggaaatactattgacacgttccaataaatggtgtataaaatagatatagagacaaggaggtacggaaaatgtacacaaagaatcagtcaatcagagaactcgtcgataagaaccggattttgattgcggctcatcgcggtacgtgcggcgggaacgtggtgcagaatacctgtctggcatataagaacgcactgcttcatggagcggatatgatcgaggtggatgcgtccatgactacggacaaagtattttacgcattccataatggggaagagcctcttgagctgggaattgaccgtgatatccgaaccatgtcatcggaggaagtggagaagctctttacgctgaattccttacggcaggtatgcggacagaagctggaacatttagaagacgtgctggagcattttcgcggaaagtgcctgatcaacattgacaggtcctggttttactggaaggagatcatcgaccttttagaccgcatggatatgaaggaccagattcttttaaagtccggcgtggaggaggaactcttaaaggaactggaagaaagcggcaccggcatcatgtatatgccgatcatgaagagcccggaggaatgggatatcattcagaagtacgatatcaatgtggccgcggcggagcttatctttaccgatctggacagtgaattcttaagcccggaattcatgggtcgtttgaaaaaagcggggatcgctccctgggtgaacgcgattaccttaaatgatgagatcattctctccgggctgttagatgataataatgccattaagattggtttcgatgagacatggggaaagctgatagacttgggattcgagattatccaaactgattggccggcgttgttaaagggatacatatcaaataaatcaaatgaaaagtaggaggagaattatgaagaacttaaagaaatttgcggcactcggattatctgcagctatggtactgtcactggcagcctgcggatcaggaacaaagaatacgacgacggacacgacagccgccaagacggaggaagctgcgaaaacagaagcggcaggagatactgaggctgcgggagataaggcagcggccggcggagacgtggacaagagccagaagctgattatttacacaaactccggttccaacggcagagatgcatggctgaaggaacaggcgggaacagccggatataatgtagaggtggtacagattcagggcggcgatctggcgaacagaattatcgcggagaagaacaatccgcaggcagatatggtatttggactgaactccattgagtacgagaaactgaaagcggagagcgtactggatcaatgggagccttcctgggccggcgatgtggatatgacactgggcgacaaggacggatactattatccgatcgtgatccagccgcttgtcaatatgatgaacgccgatctccagaatccgccaaaggactacaccgacctggtaaatccggagtggaaggataaatacaccatcttaaacttcggcggcggcaccggtaagaccattcttgccagcctgcttgttcggtacaaagatgataatggggagtacggcatttccgatgaaggatgggattttgtgaaaagctggattcagaacggccacatggaagtacagggagaggactacgtaggaaatgcgatctccggtacagttccgatcacagagatgtggggaagcggcgttcttcagaatcagacagagagagattataagttccagatcatggttccggaagttggcgttccatacgtaaccgagcaggtggccatgattacaggttccaagaagcgcgatcttgctgtagatttcgccaactggttcggttccgctgacgttcaggcagagtggatgaaacagttcggcaccattccgtgccagcctaaggcagtggaggaagcaccggccgatatcaaggaatttatggatcaggtacatccgcaggatatggattggggatttgtagcagcaaacatagatcagtgggttgaaaaatgtgagcttgagttcttacagtaggtgacggacggcggtatggtttatgaatataaatgataccgcctctttgtaaggagaggaaaaggatgattgagtttaaaaatattgagattaaatacggggattttgtagccatcaaggatttgaatttaacggttggcgatggggagttctttacatttctggggccgtcgggctgtggcaagacaacgacactgagagctctcgtgggcttcctcgaacccagtgccggacagatcctgatcgatggaaaggatgttacccacactccggtagagaaaagaaatatcgggatggtatttcagagctacgccctgtttccgacgatgaccgtctatgagaacctggcttttggcctgaaggtgaagaagctttcagcggcggagatcgaccggaaggtcaaggatgtggcgaaggtcatcgagatcaagtcagagcagctggtgagaaatgtatccgaattatccggcgggcagcagcagagagtggcgttagccagggcgatcgttctggaaccgaagattctgtgcctcgacgagccgctttccaacctggatgccaagctgagagtgggccttcggagcgagcttaaaaagctgcagaagaacctggggatcactaccctatacgttacccacgatcaggaggaggctcttaccctgtccgaccggattgccgtgtttaacaatggatttgtggagcaggtggataagccttacaacatctataaccattccgggtcggaatttgtctgcgattttatcggtgagattaaccggctgaacgctgctgtcttaagcgaggtcgagacccagaccggccatgcgctggatgggaataagagcggctatgtgcgtttggagagaatcagtttaaaggaaattccaggctatgcgaagatgcatggagtgatccgggattacgattataacggagtcatgacgaaataccgcgttgaagtcatgggatgtgagatccgcgtgatccacgtcaatgacggacagccgttcatggaaatcggccaggaactggatatctatatgaatcccagggatatcatgcaattttaaaaggagggagtttgtatgaaacagagaagcaagagtaagtctttcagtatacagaccctgattttaaagattgtcattgtatgggggccattgttgcatttgtcatctacccgaacttaaacctgctggtcagtgtcttctataaaaatggacagttttctacggaagtgttcggaaaggtcttcggctccgccagagccatgaagagtcttgtgaacagcttcattctggcgttcaccctggtggttacggtcaacatcgtggggacgctcagcgttcttctgacggaatactgggatatcaagggcgccagggtattaaaacttgcatatatgagctcgctgatctacggcggagtcgtgctggtatccggctataaatacgtctacggggccaacggactgctgacaaagcttttggtgtcagtatttccgggcatgaatccgaactggtttgtgggatatggggcagtcgtgttcgttatgacattttcctgtacacagaatcatatgatgtttttaaagaatgcaattcacggactggattaccataccattgaggcggcgaaaaatatgggggcgtccggaagcagaatcttcttccagatcgtcatgccggtgttaaagcctacattttttgccatcactatcctgacgttccttaccggactgggagccatgtcggcacctctgattgtcggcggagagaatttccagaccatcaaccccatgattattacatttgcaaaatccagcttttccagggaggttgcggcatttcttgcggttcttttaggaattgccacgatgattctgttggcagtgttcagcaggattgaaaagggcggaaactacatatccgtgtcgaagacgaaggcaaagctaaagaagcagaagatcagcaatccggtattcaacgtggcagcccatgtggtcgcttacgccatgtttgccatctatgtgataccgattatcctggttatcgtatattcgttctgtgattcactgactattaagacgggcaatctgactctgaattcgttcactctggcgaattaccagaagctgtttacgagcgcagaggcgatcaagccgtacatcgtcagtattgtatactccctgctggctgcggttctggctgtactgatggccgtgatctgcgcccggtttgtgcgcacggcaaagcataaatacgacgtatttttcgagtggggcatgctgattccatggcttcttccggcaaccctgatcgcgctgggactgaccacgacctacggggagcggcagccgatcctgtttaactatgttatggtaggaacgctggttctgatgcttgtgggctatacggtcgtcaaactgccgttctcttaccggatggtgaaggcggcgttcttcagcatcgacaatgatctggaagaagcggcgaaatgtatgggtgcgggtacgctctatacgatgataaaagtaattcttccggttattttcccggcgattatgtccatcatcatcctgaatttcaacgggatgttatcggactacgatctgtctgtattcctttaccatccgctgttccagcctctcggcatcgtcgtgaaggccgcttcggatgagtcggcatccatcgatgccagggccatgggctttgtatacacggtcgttctgatgattctctcttctgtcgcactgtattttggccagggagatggaatggaacgcatcagaagatggaagcagagacggtttgagaagagagtggcgaagggatgaggaagagatcaatagggtaagaataagagcagaaggtaaaaaaagaaatcaacaggcaaaaaaagagatcattacagggcgccgcatgaaagatatcatgcggtattcctgtttttcaggaggcggattagttgaatgaatttataatggaacaatggatttttgtagcccggctcctcggagcggctgtctgcggcgggctgatcggttatgaacggcagagccggaagaagacggcgggcgtcagaacacacgtcatcatttcggttgcggccgcgactatgatgatcatctccaagtatggcttcaatgatgttctcggcgaatatgtccgccttgacccgtcccgggtggcggccggtatcgtgacagccgtcggatttatcggctcgggaataatctttttccgcaataacaatgtgagcggaatcaccacctccgccggtatctgggccacggtgggagtgggtatggccatgggctgcggcatgtatgtgctgggcgctgtgtccacgattattgtgatggtttccgaggtgtttttagggagacggggatatttttccagaaaggcaggagaagagcgggagctggagatcgagtataaggacagcgacaaagaagatatcttttcctatattaataagaccatagaggacgcaggctgcaaaatggagaatataaagctggccgacgaggattccctctgcgttctgagtgcggttttaaaagcgcctgatgagctggatgctgccctcctggtgggggaactcaaaaagaaaaaatcagtgaaacgggtatctgtctgaacaggttgtaaaacacagggatgagaggggaatacatggagacagtgacagcggcagtggagtatctggaaggcatcaatctggcttccatcaccatgcggatcgtgatgtccatggtctgcggcggtgtaatcggaattgagaggggcaaagcacatcagccggccggaatgcggacgtacatgctggtctgcatgggcgcggccatggtcatgctgaccggacagtatatgtactatcatttccagaccggtgatccggcgcggctgggcgcacaggtggtcagcggaatcggtttcctgggcgccgggagcatcattatctcgggcaagacgaagattaaggggctgacaacggcagcaggcctgtggactgctgcatgtattgggctgagcattgggattggtttctatgaggccgggatcattgccaccctggccgtgtcgctcattatgacacaactgaagaagctggagtaccatctgatatttgatgacgtttggctcagcgtgtatgtggaactggacgacacggtcaaaatgacggatctggtccgggagttttcacctgccggcctggtgatcggcgaggtgcagattgaaaagaagagaaaaggcttccagaaggcggtgatcagcttaaagaatacggaacataagagccgggaggcagtgcttcagtttctggaagaggtggaagggattcagtttgtgaagtatacggcttaatacggtgcaggagcttcatatgaataaacgaaggaaggagggcgtaagcggtttaccagcttgccctccttcttgatttgtgattaaatagttttgatgctgccattagccgatagagttcccggccgtgaattccgctttaaaatacgaattccttatcaaataccagattcccaatatcttcgcatttccactttgtaatagagccaaaacattgttccgcatagtccagaggcgcctgtttattcggatagagagagttgatcaggacgtatttctcctttgtttctatcagcagcaaataccctggcgccaattctacaagatggacttttacaggatcgggatataggggctctttttcataaaactgctggtgctttatatccagcacggcatacatgtaacggactatttttaaggatttgaactgttcatacatgacaaaaaacgcatccagcccctggctctcatcgtggttggtttggtccaatatcatatttctccagccggaggtcgattcataatagccgtattggcgtgcggcgtactcatgaaaaaaccaaaacggcagcggcagcaaggtgtcggtatgatcctcgatagacagccggttaagagccatggaatacccgtttaggaagctgtacagggctgtaatgctgtgatccccgatatacattgcaggccttattttgattagatccagaatttcgtaaatttcattcatttggatatcctttcgtggcgggaggggccatcttacagccactccccaaacctccgaatataaattgctttaaaaaactgcgttgacagacagtagcctgcaagtagaagtaccagccatggcaggaatccaagcggcaggggagccatatccaggccggaggccagtgcggagaatccaaccagaacggctgccagggcgacgatcgtggttgaaaggagcagcggcttcgcggccatgctctgtacaaatggtactttcccgctgcggatcatgtgaatgaccaggacctgggatacggtgccgaaaacgaaccagccgcactgaaacagcggggccatagccggcgtatttgctttgatgatccaccacatgaccgcaaaacagaggatgtcgaagacagagctcagcggccccataaaggccatgaaggatttgatggaccgggtttcccatttccgtggcttttgtaagtattccggatctacgttgtcaaacggaatccccatctgcgaaaaatcacaaagcaggttttgggtcagtatttgaactggcagcatgggaaggaaggggaggaacagggaggcgacaatcaccgatatcatatttccgaaattgccggaagccgccattttaatgtatttgacgatattcccaaaggtccgccggccggccaccacgcctttctccaataccatcaggtctttcttcaacaggataatatccgcggtttccttcgcaatatctacagcggtgtccacggaaatacctacgtccgcctggtgaagcggcggggcatcattaattccgtcccccatataaccgaccgtgtgtccattggtctgaagcgctttcactacccgctctttttgggaaggggacagcttcgcaaaaatactgcagcgttccacagactctgacagtgcggcatcatccatggcctccacttcttttcccgtgagatagcaggaagtctccacgcccaccttactgcatactttgaccgcaacgccttcactgtcgcctgtcagaacaacagtccgcacgccgtggctatccagggcggtgacagccgcctttgcactttccttgggcgggtcaagaaaacctacgaaaccaatcagtaccaggtcccgctcatcgtccacgctcaattccccgcctgccacatcatttttctgcgccaccgcaatcatccggagtccgtccctgttgtgctgttcataaacagcccgaaccttctgtaaaagtgtttcatccagcttaaggatctggccgttccattctgcgtaggtgcagattgccagcatctcctccacggctcccttggtcaccagctgctgtttgccgttccggtcttccaggagtacgctcatcctgcgccgggagaaatcaaaggggatctcatccaaccgggtgtagctgtttaagatggcttcaatgccgttttcatgagcccggtttatgatggccagatcaagcagatttttaaggcccgtctggaaatagctgttgagaaatgcgtgacgcagggtccggttatcgtcatcccccactacgttcatgtatttttccagaataattctgtcttccgttaaggtgccggttttgtcggtgcagagtacatccatttcgccaaaggtctgtatggctcccagggttttgacgataacctgatgctttgacatgagaacagccccttttgccagcgtggaggtcatgatgaccggcagcatctccggggtcaggcctacggcgatcgtgatggagaacagaagcgcgtcgccccaatctccctttgtaaagccgttaatgagcagtacgactggcaccatgaccagcatgagccggattaaaaggctgctgacagaatcaacgccccgttcaaaactgttttttgcccggtctccggacagggatttcgccatggagccaaaataggtttcgttgtttgtggccaggacgatgccggttgcactgccgcttaccatgttggtacccataaaaccgatgttttgaaggtcggtcagcgcgtcttccctgtctgaacggatatccgcatatttttccaccggattcgattccccggtaagggagccttgagcgacaaatgcatctttcgtgaaaacaaagcggatatcggccggaatcatatcgccggcggaaagccgtaccatatctccgggaacgacgtcttcgatgggaatttccgtctgcacgccatcacgcaggacgtcggccttgttggaaatcatcttcgaaagcttttccgccgccgagttggagcgttctccctggataaatgcgaccaggctggagacgattaccaaaaacaggataatgcataccgtaacgtaatccgggtgctgggagtaaatgacatctgtaaacagtgtgataacggcgatgataagcagcacaatattgaagggattgacaaccgcgtttaccagacggtgaagcgtggtattgctctgaccggttgtaatgatattttttccatactcctcctgaagctgctccgcctgctttgcagtcagccccgagccggagacggaaaaatggtcaaacaagtcttttaaatcaagaaatgcaaagttacgaagaagtttttcgctttcattttgtttctgctgaatctgagagtttctttttctgaatctgaaaatgttctgattgagtttcattgggaattactcctttccataatagagttcccataaaacaacatagaatccggccagccggattcccgcgccggaacgcggccgtgccagcggccatatttccctaacgtggagcgcgcaccctgcccggaaggcttttcctgttacacaaaaaaaaccaccccgaaaggcggcgcaaaagaaacgacagttccatctattcctataaaagcacaatagacggccggtcgtatcccatggtacctacgcggttcatgttgtgatatgagattttgaagacgtttttacgacttcgagggttgccgtccattgtttcacctccttgtaacatagactggacattttgaagtgactacgcccatcatagcattcctggcgtgatgtgtcaaccgagtgtcaggataaaatatccgataagaaaaatgatgccaaacatccgttcttgcgttataatggtctttaggtaatgcaggaggaagataactatggatatcaatgatctgattatttacagaagaaccatgccggagcgaagtgcccgttatgccggcttcccggcggagcttccggaggaactgcgggaatatctgcagaaaaacggggtgagagggctttatatccatcaggcggagatgtttttaaggtcgttgaaacgggagaacgtggtgattaccacatctacggccagcggaaagacgctgggctttctgcttcctgttatcgaggagattttaaggaatccgctggcgcgggcggtcttcatctatccgacgaaggcgctggccagtgatcagtaccgcgcgatccagccattcattgaatatttcggaaagagccgcatttcggcgggagtttacgacggcgacacacccgcgggcgagaggagccggatccggaaagaagcgaatattattctgaccaacccggagatggtgaatggggcatttttgccgaatcacagtaaattcggattcgattttatttttacaaatctgaagtttgtcgtcattgatgagcttcacacctatagaggcgtgtttgggtcccatttggccaatgtattccgccggcttcaccgggtgtgccgctactacggttcatcaccggtctttctgtgcagttcggccaccattgccaatcccgtcgaactggcggaggagatctgcggaagaaaattcgtgcggatcgatcgggatggctctcctgcggcagagcggacctaccttctgataaagcctccgaagattctggggcacgataaaaagtactatggacaggtgcaggccacggcggtggcggcggagctgatcccggagctggtggaacagagaaagaattttatcgcatttgcccgctcccgaagaaatgtggaggtaattctaaaggaggcgagggaccgtctcgaagcggaaagtccggccagtgcgtcccaggcagataaaatatccggttaccggggcggttacacgcctgcggagcgtaaggagatcgagcacaagatggtgacaggagcgctgtgcgggctggtgtcaaccaatgcgctggagcttggtatcgatattggtaagattgatgctaccgtgctggccggatatccgggaacgagggcatccttctggcagcagacgggccgggccggaagaagcggccgggcgtgcaccaattatctgattcttgacagccagcctttcgatcagtacatcggaacgaacccgggatggttgttcgaaaacagcagtgagagcgccgtcgtagacaagaacaaccttttaatcgaactttcccacatcagggcggctgcggcggagattcccctgacgttggatgacgcctctgtctttccggatctgggcgagacgattccggtcctgatgcgggcaaaggagctgaccggacagaacggcaaattcgtgtggtcgggcggttccttcccggccggagattacagcctgcgcaatattgaccccaaccggtacaagctgctcttaaaggacagcggaaaagagatcacggagatggatgagatgcaggcgttccgcgagattcatcccggagccgtctatttacacagcggcgttcagtaccaggtggtgacgctggatctggagacaaggacagcccgtgccgtgccgtttaatggaaattactatacgacgcccatggggaatacggacatcacgatcattcacggcaggaaagagaagccgtggaaacgaatagatgcggtgttcggtgatgtaaatgtcaacgcacaggtttccctgtaccgcaagctgcagtttcataatcatcagaatctgggctatgaacagattaacccttcgttatccagagaattcgaaacagaaagcgtctggctgaagctcccgggtaatgtggtaacggcctaccgccgtctgctgcaggagagtccaaacgggcagatgatccgaaacaatcattttgaggggctgtgctgcgccattcgaaacgcagcgcgcctggtaacgatgacggagcaggaggacatcggcacgactgtcagcactaacgccgtttatgcagaaaaaagcgctgaggagtccgtatatctctttctctacgatcagtataccggaggtcttggatatgccgagaaagcgtacgagctgattccggagattatagaaaatggtatcgccatggtgagcggctgtccctgcgaggacggctgcgccgcctgtgtcggtgactaccatctcgataaaagtatggttctgtgggggcttaggaatatgctggaggagtctgaagtgccgaaacatgtgaaaatggcgccgtacggcccagcgacatttatacagaagccatttcggtttgacgagctggaagcgcagtggaaggcatttaccgccatgctgctgaaaaacggggaaccgtttgcgtcctttttaaatacggtgaatgcggtcaggacggaggggaggagactcgctctgattacggatcagccattttaccgggagtggatcatggaggagacaaaccgaaaggcccttaataatatgatatcctattatacggacgcaccgaaaggatttgaactggaggtggaggttcggaaaaaagaggaaaacagagagaaccgggacgatggctgtggtgaaaacggcggggacagaagcggagataacagcgatatgcggaaaaagcttgagcagaggcttaataagcttaagaaaaaggagaattaggtggactgggaaagagaatgggagaggctgaacccctatcaaagggaagcggtcaccgatgaaaataaagcctgcctcgtgagtgcgaatgtggggagcggaaaaacgacggtgctgactgcgaagattctctatctccatgaggtgaagcatgtgagttaccgggatatggtggtgcttacattcacaaacaaggcggcttctgaaatacgggagcggcttgtgcgtgcggacccgtcagtgacgccggaggagacggaaaacttcgggacgtttcatggcgtggctctgggactcctgaaaaaaaggctcccggtggagaccctgggatatacgaaggacttcatggtgatggagccggatgaggaactggagctggcccatacgctgatagcggagaagaagctgaagataaagtacaagaaccggctgagaaagcggctggcggaagcggagcgcgtatcggcagcgggcgatgccggagtggccggcagccaggatgatctggaaatcctggcagggcttctcacggaggaaaaactcaggcgaaataagatgacattttcggatctgatgaaaaatgcctgcctcctgatggcgaaagaggaaggggaggaagagagatctgcggatattcaatgggtgattgttgacgaagtgcaggactgcgatggaaaacagctggaatttatcgattgctttatggcagagggagcgaagctgtttgcggttggagatcctaatcaggtgatctacagctggcgtgggagcgcgtttcatttgttttatactttgaagacgcggtatcaggcggcagagctttcactcccggtcaattaccggtcctgcattgagattctggaggcagcccggtgttttcagcagaatggcggggctctggaagggataagaggaagcggggaaaagattgtggtgaagaaccactacgactcctttcaggaagcgtgttatctgactgaccggattcgtgaactgcagaaacaggggattccttttgacgagatcgccatattttaccgcttgcagagccagtctaaggtgctggaggatgtattttcaaagaatggaattccatatgaggtggccgtaaagacggggatccatgaaattccggtgctggaatggctcctgcggcttctgcgattcctggcggacccggccgaccgcgctgctgcggttttcgttctgagcagccgggaatacggcgtgggaatttctgcgaagaaggtggaaaaactggcagaggaaggctgtgcgggagtatgcggccgaaaggaagcttctgagagtggatcagaaaaagctgcggtgcccgggctttttgaaagaatggtttcgtttgaccgaaatggcgctgagataaaggatacgaatgcattttatgagtattttgatctggattgttcactgaaacccaatgcagcgtcttatggggacgataaggcaaatgtccggcattttctggaccgcatgtttgcatttatgtatgcaaaagaccttaagctttcggaagggcttcgggaattcttgaattcagcggcgctttatggaacttctcgggaactgcttcctgaggcggacggcgccggggaggcccgcgtgaaaatgatgacactccatgcctcaaagggactggagttttcccatgtctttatcattggtgtgaattatggcctgattccgttgcggacgaaagggatagacggggaagatgaggagagacggctgtttttcgtgggaattacacgggccagaaattatctggagctttcctggtatacaaatcccgacatcttcggtgtgatggccggggaaagccgttatatccggatgattccgtcagaactggtgcagggacaggagccggagaggcagacgggaactgccaacttacaggagctgcggagacaggtacagatggcgaaggaaaacggggagaagatggaagaaaaggatgtggagaaagcagatgagatgaaggaaatggaggagaaaacgccaaacatcgaatctgtatctgccgaaatactggttcgccacgaaacatacggatgcggcaaagttgttgaagaagatgacacgatgattaccgtagaatttgatggatacggaagtaaagaatttatcaaggcatttagctgcctggaaatattaaatggacaataagggaggaatttttatgaactattatgctggaatggacataggcgggacgaatggaagattaaaactgaaagacggagacgggaatatcctcggggaattcaccgggccaggctgcagtatcaatacggacggattcgataagagccggagccgctgccgggaactggtgcttccggcactgaaggagctggaactgaatccatcggactgtatggggatttgtgtggcggcaagcggaattgattcaccgggatatgagaagatgtgccgggatatcttcgaggaaatgggatttaagtccgactgtatccgggcagtcaatgactgtgaggtctttctgtatttgaaggaggggccgtcgatggtagtggtatccggtaccggttccatctgctatggaatcgatgcgaagggcactatatacaggactgggggctggaatcatatcttaagcgatgagggcagcgcattttatctgggtatgcagactatgagacttgcagcagaggatctggacgagaggaccaaatgcccgtatcttacccggatgtttatggaaaagagcggcctggatacgctggaaaagattgatttgttcgtgaatgagcatttgtttgataagtcggaaatcgcccgcttttccatgattgcctatgatgccgccaaacagggagatttacaggcggaaggaatacttaaggactgtgcggagaaaatatggaaactcattgaagatactgcccgtaaggccggctggattgaacagagccaggtgtcccttgcgagcgggaaggaaaaacctcatctgtggctgtggggcagtgttctggttaaaaacgagataatcagagatgaagtggtaaaaagggtgagacaggttatgccggaaatcgatgtcgctgttccggagacgagtgcgcttgatctggctttgatgcttgcgggaaagatcagataaaagagcttatctgcttaaatggaggtgaaagtatggaaaaattgggggctcaattcttaaatcagatagacattcttcttcagaatgcgcgtaacagtgttaaaacagcagtcaatttgacgatggtctatacgtactatgatatcggtcgtatgataattgaagaagagcagaatggtgttaatcgtgcagagtatggaaaatatattctaaatcaattatctgcgtatttaacaaataaattcggaaaaggattttctgttactaatttgaaacaaatgcgtcaattttatatgatttattcgcacgataaaattggtcagacactgtctgaccaattcaaaggactatcatcggttgagccagaacgtaagtttgtcttaagctggtcacattatctacagttgatgaggattactaatgttaatgaacgccatttttacgaaattgaagcgatgaagaatggttggagtttatcagaattgaaacgccagttcgatagttctttatatgaacgattagcgctaagtaaagataaaaaagcagtggcacggcttgctgccgaaggacaggtagtcgagtcgccacaggacttaattaaagacccttatattttagagtttttggggttgccggaattacctgaatattcagaaacggagttggaaagtaaaattattgataatctgcaaaaattcctgctggaattaggtactggatttgccttcgttggcagacaagtgcgatttacttttgatgaagaacattttagggtggatttagtgttttttaacaggcttcttcgctgttttgttctatttgatttgaaaataggcgaattaaaacatcaggatattggtcagatgcagatgtatgtaaattactatgatcgaaaggttaaattaccagaggagaatcatacgattggcataatactatgcaaagataagaagcaatctattgtggaaatgactttgccggaaagtaataatcaaatatttgcaagtaaatatgagacaatattaccgagtaaagaggacttaaaattgttattggaacagcaatcgtaaatacagcgaattaaaattcggttccctgcagtagttttgcaggaaaccgatttttatggtactaacgaaagacattgaaaatgtggttcgcgatcatcattatattatttgtattctcatacgtgctccggatccagaataggcgtgtagacctcccggctcccattcatctctataagcacagagtgagccgggatttcaatattctcatactgataagaggaatcaccgaaattagcaaccgcaatcgcggccgcatccccgccgcctccgaatacggttttctgcacgctgccgtcctcgctcttatattcaaaaccggtcatttcccgggtgacagccgtttggctgaagtccgaccagacggtttggtggcggagaatgtcttctttgtactttgaccattccaccgcgtcgaggtgatagaggggagggacgttgtaaaggatttcccgtatcatacggtctgcagtcgcgcccttgattttgaaggttgaccagtcccagtggtagcttgtgatgacagaatcattgtagacgagcttgaacagcggaatatcgtatttcgggtccacaaaggtggtatggtactgtttttttaccggaatccgtttggagaaatgttccgcgacaccaccgttaggattgtagtactttccgatataatagtcgctgtcctgattctttttcatgtcctcatccatccaggcaaatgtcttcagttctatcccatgggcgtatgcgatatcagaggctgcgaaatcattgccgccctccgagccgatgacgagatggtactggtctctgatgtaagacatacgttccagtctggcggcaagatcttcctcctgtgtggtgatgtgagaaggtgtgtaatcgtcatagatctctccggttgcgtcacagtcgataaaccaggagttaaacgggagctggctggacataatgccttccatacgatttttgacggcaggaagcgacagggcgggatttaatttgcggccaacgttctgaaagccgctttccggtttgccgttctgatccgttatgactgcgttttcatacagggatggatcgtcaaactgagcggtaatccactgctctctgccgggctcgtgaatcgaatggtaggagtcgtagctggcgatgagataatcctggctgaccgcagtttcgaccagctccggttttccatacgcctgttcccagctgttaaggccgatccatgcgtgttcgattccgccttccttcatttcctgaagcagagtaaccgtctgggaatccatccactgtccggcatcggcaaatacttccggtaaatttgatgcgacagcatatttgtgaacctgaatccggtccgtttcacttaagttaccatatccttttgccaggagaacctctaactctgaagagcgctgcgtaaagacagatggttcccagaaatcatcccgtttcaaaagctggctgatgtagctgcagattacatttttctgatactctgccacgtagtcctggccctgtatttctttcaggacagatgtaaattcctgaccattttccaggcgtccggcaaatgacagaaaatattccataaccggcgaggaaagagacgttcgaaatgcctgccagttgatatcatccgctgatacggcgaaatcaccccaaagatagatgaaaggagctccgtacagcttacggatattgggatttgcctccgctttctgttccagggtggtaaactgtccctgctcgattacgtaattgcgatacagcttggccgcgctgacaggatctttgtccgtgatgtaaattcgaaatttatttgtccggttatcgtcgatcgccggatactgatgggagacagagagcgcgatgggggaatctgaagtaaaattcatctctgtccggtaaggatcttccataacgaacaggaggttgtagcttccggcagatgagatccagaacggcatggaaagctgctccatcacctggaattcctggccatttaaataatcgaaccaggccggatcgtccgcaggtacccgcttgccttcgccaaagggaaaatagtaggtatctgcggagataacgggccatgtaaaggaattgtcgttctcattttccgaggtaatctccacacttaaatagtccttttcgggagacagggatactgatatctgctcatcgggatagcgccagctgacggtatcgccgacttttccatagtccagtacggttctccgttcccccttagcagctgccgttataagcgtctgttccacctcgaaggacagggtgaattcttccggctctacctcaaaatcaaagggaagtccggtatcatgagattcagagacctccatttcctccgggacggccgcagatgacggttccggatgctggatgttggacacacagccggttaaagccagggtcaatggcagaagcaggcccagctttttagacagtaaatttttcattgtaaactccttttctgatttttcattttgcgcgcagggaatcgggcggacaggaatgcgtatccggccgatgactgctgtatatcgggcatttgattcatacaaaagggattataaggctcggttgttacattcatgtgacaaaatagacatggattgacaatttacatgactggaatgatatggaaaaaggaaagcatgatggccggttgcttttcttccagagtccgcttataataaatcagcaggccgtaaaggcaaattccaacagacacagaaagattacgataccagactaacagaccaattaccatatcaggagaccacaatggagtttaacgaaaagctgcagcagctcagaaaaaagaataatctcacccaggaacagcttgcagagcagctgttcgtatcgaggacggctgtatcgaaatgggagagcggcaaaggatatcccaacatagaatcgctgaagagcatttcaaaactattttccgtttccatagatgatctgttatccggtgacgaactgatcagtctggcggaatgtgaaaatcgttccaatataaaaaaggtatacggactgatgggcggaattatcgatgtaatggcggccgccttcatttttttaccgctgtacggaaagccggagggcggacatatctaccatgtgaatctattgtcctttacggatacaacaaaaataaatctctggatatactggggtattttttgttttttgatagttttaggaatcatgaggctgattttgactcattatgataaagaggcgtggctgagcagtgtcaccagcggttcggtcgcattgagcgcggcggcaatctgtttttttgccgcggcgagggaaccatatgtgacagttctgatgtttctgtttttcatatggaagattacgttgctgtattacataatgaatcgtaaacagcatcaggcgaaaacttcgtgaaaacgtgataaaaaggcctctgacacgatacgtgtcggggcctttttaccattgtgagagtaagtttcttgtcttttctcagtagaaagcagataatctcaatacagcctgcaggcagcaatctcgtaatgaaaagaaaggatacatgataatgcttaagaaatcaaaacaatctctcatcatggcagcaagtctgtttttactctttataatttttacggttatggttaaaacaattgatgtaagaccgatcggaccggaacagtcgtccgtcggtttcgcgtcagtcaacaaattcgtatttgaactgttcggtgtgaatccgctgtggtataacgtaagcgaatggatgggcgccgccgccatggcgactgcgttcgggtttgccatggcggggctgttccagcttgtaacacgcagaagcatccggaaggtcgatgtcccgattctggtgttgggtgcattttacggtatccttgcggcctgttatgtgttcttcgaggtcgttgtcatcaattacagacccgttattctcacacaggggtcagtactggaggcgtctttcccatcttcccatacgatggcctccatctgcattatggctacggcgatgatcgaatttcacgattatctgcgaaagcggcgagggtggctgatggcagcggatactgcggctgttctgatccttgtattaacggtagtcgggagaatgctctctggcgtacactggtttactgatattgtggccggtgtgatcctttcggcggcgctgatcgctctgttctgtctggctctgcaatatacagaggaacgatacggcagagcaggaacggcagattctagaaaatgacttcaaatgtaataacatggccttcccgtatacagcggacctgatatccgaacgtatcagcgatttttttgacgatcggcagaccgagtccggtaccggacagtgccttgttgcgggagggctctccgacatagaacggttcccagatccgttccgtgtccagatcgtcatttccaagttcgtttgtgatccgaaaacagcactgcccatcgtttttgccgagttctgcatgtacggtgccggaggcggcgtattttaccgcgttggagagcaggttggaaaacagttccgtgaccagctctgcatttcccgtgatttccagattcggtgtgacggctgtgtttaggctaagcccccgcttggagagaaagagcttctgctccccgatgcattcagaaagcagcagatccagcctgatggtggtcagcggatgttctttccgctcgattccagacaggttcagaagccgttctgtcatctgcgacatccggttgttctgctggatgatggtttctaaaaaggtgccgtcgtccagcccatcctggattccggaggaatacatgccgatcagggagatgggagtctttaagtcgtgggccacgtcgtttaaaagctgttccatctgctgatttttggcctgaagcattttctgatactgctgtatggaaatgctcatctggttcatgctgtccgcaacgtgctccagctcatcgcgggtgctgatatgcagggaaccgtactcctgatgggcgatctcctgcgagaaacgctccatgcggcgcagcggattggtgatatgttttaccagtaaatacagcagtaccacggcgataatcagggaaatgacatgaagcaggatgctgaaacggttgataatcccgatgaagtccgccgtattgggaataatggcggcgaccgcatacaaattggagcccaccgggatatactcgactaaaataccgtagtttaacttgtcctgctggtaaaggcggaactgggaacccttctggacggcggacagataatcctgatcccatagccagaatttttgaaaaccgagacccttctcgcggaatttgtcccgcagactgctgcttaacgcatcgtaatcggaagtattggcggcgtacgtgatcagcacattatcagagccttccaggctggcgacggcttcgtccggtgacattccagcgtctaaatattccctgatgcggctgccggcctggctgacatacgctgtctgctgacgcagatagtaccgtgccgccaccttcgagttgacgaaaagtgtggcggccaggatcagggccagaatcgctgccgtaccgcagatgaacttggtggacagccggtggaagcgtcgctttccattagtcatgggcgcctcccatcacgtagcccatgccgatacgcgtccggatgaggtcctcgccgatcttttttcgaagacggcggatattcgtatcaacggtgcgggggtctccctcaaaatcaatcccccacacgtggttcaaaagctgttcccgtgacaatacgatgtttggattggagagaaaatattttaaaagttcaaactctgttttggtgagaaccatcttctgatggtcttttgtcacttccattgtgaccggattcaggcggatatcatggaactgcaggacatcagccgcattgcacagtttttttatgcgaagtaaaagaacctgtatgtcaaacggttttcgcaggtaatcatcggcgccgcaggaaagtccggctatctcgctttcactttctccctttgcagtcagcatgagaacctttacggggatgtttaaaagacggatctcttttaaggtctgaattccatcctgaaccggcatcatccagtccagcagtaccagatcaaccgtgtgctctgtcaggaaatcaacggcggcacggccgtcggaaaccacgtttaccagatagccttcacgctggagataaagctttaggattttctgcatttcaggatcgtcttctgcgattaataatttcatggcggcctcctttgccggtaattggcaggcgtatccggaacggaagcctgccgtagccatgatggctgttatgttaggataatatagattgagattttgtgcaaggagtgtctgacttttttactatgtcaatggcatgactcgtaatgcccgctaaatcctcgcgttcacagaccgcaaaatggtattttaaatacagttcaaacgcgtcacggtccatggcatctacggcctcgcgcataaataaggcacagccatccgctgcgacgtaatgcagacgggttacaggaagggcagagatcagatcatcgatgtcctcttttctgacaagctcaaataaatcctttggctctgacttagcggcgaatgtccgggaatcaagcaggcctttttctatatattcggcgacgttaatgctgccgcggtggaagccctcatcaaggaggcatccgtcggatatcacatacgcagcaaagatcacgccgcccggttttgtaacgcgaatcgcctcgcgcagagcctgcagcttatcctctttggtgtaaaggtgatacagcggccccaacagcagtgtgatatcatatccgttgtccggaaatgcggacaggtccatggcgttgccctgggtgatcgttatgttttctcctgcctgggtgtttttacggaaaacatctatgttatggccaaccagttccaccgcgtccacggcacagccctgacgggccagagcgtgagaataccggccggttccggctccgatttcaagcacccggtccccttgctttctatatttttcaatgtagcgcatcgtggtgagaaattcaaccgatccatgctttaaggccagccggctgtcttcgtcatattgattgtaaaaatcgattaagtattggttttctgtcataggggactccttctaccgctggggtgcgtctggtttttcctgatgaatgagggcggataacaggttcatcaacatcttttccgcatggttcctgtcaaatgagatctttttggccgctgtcagaaccgctatgccgtgagtataaagaaacagatccaaaaagattacctttgcacgttctaactctacgccgatggtttcggaaaagagtgcagcccttttttcattatcggcttcgtgataaaaatcctttgcctcagtcatattcaaatccatatcgttgataaataacagtttaaataagtttgtttcttcctctgcaaatgcaaggtacgaaagaggcagtactaagcagggatttacatcttcagtatgactgaaatcgatcacataccggttatagtattcgtatgcaaaatcaagaaattccttttttaattcctccatattctcgtagcaggtgaagatcggacgggtagaacactgcagtctgccggcgatgctccttgcgtttactgtttcgaagcctgttttcttcgtgatctcgaggaccgtgtttaatatcatttcttttgtgatttttgcttttggcggcataagcgtctgcctttctgttttggaattgatgtgttgcatgtgttgtgtaactattgttacatattggaaagacaatgtcaagagagaaaattatttgtatcttgcaacagttcagggcggcgggaaaaactgctgccgtattttatttaaatctcttccgatactccgagggcgacattccatactgcttcttaaacaacagataaaagttctgcctggagtttatccccacaagctcatcgatatcgctgatcggagtatcggagtggagaagaaagtacacggccttttccatgcggtacttagtcagataattccagatcgtaagccccgtcttttcgcgaaagattttttgaagatagaccttgttaagcgctacatacgatgcgatctcatcgatattctcaatggaaaaaaagtgataattgatatagtttttgatctgctccacataagtatctgtggggcttttttcggcggaaagaaggcggacgacttcgatcaaggccttattgaccagaatatttaagtagtaagggtcttttttgttattggtctcattgcagatctcctcaagcaggtgaaagatatttcgcgcattctgaatcaccaggccggtattcaagtgctgaaaaaatgtgccgaggcagggataggctttgacaagggcggagagcgtaccgatggaaggcgtaagctcagactgatagtaattaatactcatattgatgcaggaatcaggggaaatcagcttgtgcggcgtatttccgttgacgatcatcaggtttcgtttcttcagattataaatttcacctgcaatatcgtaatagcaggttccctctacaatgtaattaaactcgatggatccggccggatgctgatggtagtccatatagtatttctgccagttcatatagcagatctcttcgggcagaaggacgcagtccggattcgtaatttgataagcgttttcgtatgccatagcagtttctccttttcatctcgattgtccgtataaccgtctcttcctatcctaccgcataaaatccccactgtcaaaaaaatgtaataaataatagcttcttaataaaaaaagaccttattttaaacggtagaaacatctatgaaatccgtgtatattaatacatgtaaagcagtgaaccaaagtagtcaagcacccgtatgaagcggggattctgactcacgcggccgccgtcggatggacatgtgggcatgtctgcctggctcgttgaccgcggtaataaataaaaaaattggagggcagttactatgaagaaaaatttggcaggactttttgttgcagcggcaatggtggtatccttatgcgcatgcgggtcagggggaagcggcagtacaactgcagagaagaccagcgaggcagcagcgggggcagcgacagaggcagcggcgggggcagcggccggcgggggagatgcagttacactcacctatgtgacatggaatgagaatcagcgggggcagattcaggataccatcgacggatttcagaagctttacccgaacatcaaagtagatttacagatcaccccatggggggagtactggacgaaactggaggccgcggcaaccagcggaaatatggccgatatcgtgaccatgcataccaacgtagtagcaaagtatgtaaacggcggcaagctggcgcagctcgatgatttaactcagtacgatgataccttcagctacgataattatccggagggagtaacgaagctgtatacatttggcgatgcccattacggagtgccgaaggacaaggactgtgtcgtgctcgtatacaataaagagctgtttgataaagcgggcgtagagtatccgaacgcggactggagctggaacgatgtggaggaagccgccaaaaagctgaccgataaggaaaacggcgtctatggatttgccgcatacaaccacgatcaggaaggctggggaaacttcctgtatgaaaacggcggaagtatcatcgacgagacaacacaccagtccgggctggacaagccggaatccattgaggcgatggagtggtatatgaatatgaacgccaactattcaccttccaatgaaatgatggcggaagtcaactatattgagttatttgcaacgggaacggttgccatgcagacctttggcaactgggaactgagctatttcacggaaaatgagcttgtaaaagataagtttgccatcacagagcttccggcagggcctaccggcatcaaggccacacagatgaacggcctggcgctgtctgttcccagcgactgcaggaatatggaagcagccaagaagtttgtcgcttatgcaggctccaaacaggggatgtcagattccattaacggaccggccattccggcatttacgggggtagagaccgactgggcaaaggcacatgaggatttatatgataccggcgctattttgaagagcatggattacggggtacagtttgtaggaacggagagcaagacaaaatggtccgaggtcatgaatacttacgtggcgaaaatatttaacggggaagcgagcgtagaagaggcatttacccaggctgcgaaagagatcaatgaaattctggcaacggagaagaaataacaggaatccgtgaaccagggggctgctgcgagcttttagcagccctttctttcccaggggggagataagatgaacaaacgaaaatataaaaactatctatggggctacttctttgttgcgccgacaatcataggactgctgattctcaacatctatccgatcttcaaaacacttctgctgagcttttcggccagcacaggctttgaagagtatgtgttcagcggactgaataatttcacacgggtcctaaaggaccgggaggtctggatcggacttagaaatacgcttattttttccgctgtttccgtaccgggcggtatctttatcagcctgcttctggcatggctcatgagcaaggagatcaggggaagaagcgtttaccgtgttatttattttacgcccatggtggctgcgcctgcggccgtcaccatggtatgggcctggctttacaactcggaattcggctttttaaattatgtaatcaagagtctgggcggcgcgacgcattcttggctgcacgatccgaaatacgcgctgatgtcggtgattatcatcgccatatggggcggtctggggcagcagattatcatactgattgtggccatcaccaatgtgccgagagtctactatgaggcagcggagatcgacggggcgggtggctttgtgaagctgtttaagattaccgtcccgctcatttctcccagcgtattcttcctgacgataacgggctttatcggctctctgacgcagtttgacttgatttatatgctttataatgccaacacgtcaaaggccatggattcggtccgtacaatcatgtaccaatactacaggcaggcgtttgtcgtacaggataagccgtatgcctcggcaatttcaattgtcgcactgtgtctgattctgattttcaccggacttcagtttgtggcgcagaagaaaatcgtacattacgaataggaggggagtaaagtggaagcaaacaacagtaaaaaacacgtggtaacccatctccttctgattctgggcagtattgtgatgctgtttccgttcctgtggatgattttatcttccttcaaaacggttggagagcagatgtccattcccatgaagattcttcccgggagcttcggatatctggaaaattataagcaggcactggaggcagttccgtttctgcgcctgtatctgaatacgattctgatgattttggggcgcgtgatctgcgcggtcatattttccagtatggccggatatggatttgccaggatggaatttccgtttaagaggctgctgttcacactggtattgatgcagatgatggtaccgggacagatttttattgtacctcagtatatgatgttatcgaagatcaagctgttaaatacggtatttgcactgatattcccggcactggtcagcgcatttggcacgttccttctgcgccagcagtatatggcgctgccgaaggagctggaggaggctgccgtgattgacgggtgtaatccgtggcaggtgtttactaagatcatggtgccggtgacccggtccagcctggcttcgctggcgatttttaccgccctgtttgcatggaaggacctgatgtggccgcttatcgccaacaatgatttaaaccggatgcctctggcgcccggactgaccgtcctgcagggaatctgcaacaacaataagggcgcactgatggcaggcagtgtgatcgctacggttcccatgctgctgttatatattgcgtgccagaagcagtttattgaaggcattgcgcagaccggtattaaagggtaaaggagaaaattggatatgaacattgctgaaaatggaatttacttaaatctggggttgaaaaagggagaagcggtcaggctgctgcatttttcctctcatcctcaggaaatggagattggagatgacgacgtctctgtgtacactctggcggagcttcaggccagcggtttcaatcagaatgaccaccatggtctgaagcacacaggcagcagcccatccctgctcatgacgtatgagggccaccgggattaccggaatgattacggaagaaaactggaagtaattcaaaaatacaaaggactggagctgattacgcatatccagttctacgacggaatttctgcagtcaattttgtgggtgaggtcgtaaaccattctgaggaggagtatgcgctggagtatgtatcttcgtttgccttaaccgggctcacggaacaggccaaggggccgagagataaaaccggaattctctatattccgcataatacctggtttggcgaggcccagtggaaaaagtacaccttaaatgagctgggatatgacgcggtaaattccttttccatgaaacggatcgctgtctccaatacgggaagctgggcgtgtgtggaacatctgcccatgggctgctactataatacagagctggatcagtcgctgatgtggcagatcgagacgagcggatcgtggcactgggaggtcagcgatatccgcggaactctttatgtccaggcggggggaccgacttaccaggaaaatggatttttgaagcttataaaaccggatgagcactttttctcagtaccgtgtacggtatcggcggcagagggagaatttcagaaggcagtcgcagagctgacgaagtacaggcgcagaatccgcaggaaaaatgaggacaacgagaagctgccggtcatctttaacgattatatgaactgtctgatgggtgatccgaccacagaggtcttaaagccgctgatcgattcggccgcggaatctggctgcgagtatttctgcgtggactgcggctggtattccgacggacactggtgggatggagtcggagagtggctgcccagcgacaggcgttttccgggaggaatcgaggaagtgatccgttatatccgggataaaggtatggttccgggactctggctggagctggaggtgatggggatcaactgtcctatggcctccagagtcagcaaggactggttcttccagagaaatggcaggcccataattgaccactgcaggtatcagctggacttcagaaataaagaggtgcgggactatgccaccggagtcatcaaacggctggtagaggaatacggtgttggctatatcaagatggattacaatattgataccggtgttggaaccgattaccatgcggattcagcgggagagggactgctttctcataccagggcgtatttgggatggctggatgagattttcgaggcgtatcccgacctgataattgaaaactgcagcagcggcggtatgagaatggagtattccatgctggcacgccagagcatccagtctgtaaccgaccagacggattacatcaaaatggcggcgatcgcggcaaactgtgcgacggcatgcgcgccggagcaggcggcaatctggtcctatccgctggtggaaggaaccgaggaggagacgatctttaacatggtaaatgccatgctgttccgcattcaccagagcggttatttagggcagatcggagagaagcgcatgcagtatgtgcgggaaggaatcgcctgctataaaaagatccgggaagatatccgggaaggaattccctgctggccgaccggtcttgcctccatgtctgacgaatacataagctacggcctgataaatggcggaaaacagtatctggcagtttggagaaccggcggtgaaggggagaaatcatttgagatccccctggtaggaaaatccagtgcggcagccgaagtctcctgtatctatccggaaaagaaggagacctcatttaccgtcagtggaaactgtttaacggtcagcctggctccaaaaagcgcacgcctgtttttggttgtcacggaaactcgtgaacaaagttagtatagagctgcgtaagtggtcaataaccggaaaggttaagtgaggttgaagatgtgactgaacagacggtaaaaaggaaaagcggtatcaaatggaaagtaaagtgcattctcgggggaacgatgctcagccataattactatctgtttttgctggtacacacgcttttcctggtatttacgaggattcctgctatttttatcaatactcttctgatgaaccagaccggagatgtaaactccaccctgttttataatggggcgatcttcgcggcatgtgcgctgacgatgtccgtctcggcgcagatcatgcacaagacgggatgccgtgtgacggccactgtcggaatcattggttataatatcctttatctctgctatatcctgtttcagccttatgtgggaacctgctatatgcttttcgggctgtttaatggaatggcagatggcttttattatatcagctatggacatatgattctggactatacggatgtcaccaaccgcgacagcggaatgggaatcatcagcacactgagcgcgggagtgaacttaaccgtaccgtttctggcaggcagcatcctgtctgcgatcggcggcgtgaaggggtatgtggcaatctttgtactggcttttgccattgcgtttcttgccatggccgctgtatttaaactgccgggggaggtaaaaaaggaaaagagaaatgtgcggtatggggcatttatccggctgatgggagagaaccgtcagattctctatggactgctgggggagaccttaaaggggatccgggaaggaacctttatgttcattctgaacattattctgtatcagctcattaagagcgagtttctgatcgggtgtaattctctgctgacggggcttgtgtcgatcctgtccttctggttcatgagccataccttccggccggataaccggcgcaggtttatgcttctggccgttaccggactgactggaattaccattgtctgctactggtttttgaatccggttatggtgattctgtttgcggcggtaaatgcatttctggccggtatgattgaaatatcctgctataccacatttttcgatgtctcacagagtgtgaaggagatcgaagatttttcaccggagcttctggcgtttcacgagatattcgtggtgaccgggcggtgtatcggccttggagcgttcgcgtttatcaatacggtgtcgggggcaaccttaaaagcccagatattcagtctgctgctgctgacgctggtgcagtttggaacggtgtttatgtgcaggacagcggtaagggcggctgcaaggttcaaaatgagagtgaaaatagattgatttaaatgaaagaaaaaggactgatcggtgtttgagtgaatggcattcaaatacagtcggtcctttttggtatggagtaaaacttttgtttgagtgtgtggcgtaacagttctgcttccgttttgactgctgaactgttactgtgtggccgataaatacggttttattattgtctttttgtaataaccatgttatactcttgttacgcattttcttatgcgtcacgatatcttatgccatattaatggcatcacggcaagtctgccaaagcattcacaattgtttggaaatagaaagcgggaggagtggtctgtctatggaatgaatgtaaaaatctattgtaaagtaccagctatttgagtataatggaggtagaaacgtggtaaaagttaataaaaagtataaagacagattatttcgcatggtatttaaccggaaagaggagctaatttcgctgtataatgctatcagccattccgagtatacggatccagaagaattggagatttatacgctcgaagatgtgatttatatgaaaatgaagaatgatctcgcatttttaattgacgacgttctgaatctgtgggagcaccagtctacatggaacccaaacatgccggtccggggagcgttttatatcgtagaggaatacagaaagtatattgagcagaaggggctgaacctgtatggaagccgtctgattacgcttcccgttcctcaattctatgtattttacaatggcttgaaggaagagccggacaatgtagagctgaagttatccaatgcattttccacgcttcatccggaactggaaccgtgtatggaatttaaagcggtcatggtgaacattaaccggggacataataaaagcctgatggagcagtgctctgcattaagggagtatgcagaattcgtggcgcgaatcagagaatggatggaagcaggggcagaccttttggaggcaatcggagaagtgatcgattcctgcatccgggatggaatactggcggaatttttgtcatcacacagagcggaggtgttcgaggtgctgctgacagagtatgatgagcagaggcatatagcgagtgagaaggaatcgagcagggaagaggggatgcaggctggcataaggaaaggtcaccgcgaagcggccataaatttatttgagagaggtttgtgcataaaagatatcgcagtgatttgcaaggaaacttactgtcttatagcagaatggtatgaggaatggaaaatttccaaaggcgttagccgttaggatcgaagcagaatgctgcagctgcgcagaaaatcacttatttctaattgaaagtcagaaataggtgattttttgctataatcctaaaccgatagccagcaaagtattttgttgagtccttgcggttccttataaggaaaattattataaccagaaaaaatatggagatgctgctgaattataatgaattgaataagaatagggtttatgatacacttgatttatgcaacggtattcattttaacgcaattggacaaggagaccgagtacgtttatgaagatatatttttgattcggaggataaaatggcagcgagaattgtgattatttcaggggcgtgtggaacaggcaagtccagcagctccaggttgctggctgaaaaatcaccgtacgattgtgcggttcatattcacagtgacgatttctatcagtacatacgtaagggatatattgccccctggctggagggcagcgggaaacagaatgaagtcatgattgaagcggccgcggcaagtgcagagcgattttcggctggcggttacgaggtatttgtcgacggaacgatcggaccatggtttcttgaaccgtgggaaaaaattgctgcgaagggagttgatgtgagatatgtaatcctgcgtcccgatgaacaggcaacgattttgcgtgcgacagagcgggagcaaaaggcagatttccctttaagctatgaagtcataaaaaatatctggcgttcattttctgatctggggcaatatgaagctaatgtggtggataccacggatcagacggttgaggagagcattgcgatgattcaggagcggctgcaggctggagagtttcgtctgggagaataatgttattttccttttgagttcactcatacgtatgcataaagggctatgaaaaatagtaaaacagtgatataattctatcaaaagaattaaatggctcctgcaaaagtatataattgagaagaagccgggaaataaagcagcaaaccaacaataaagaaccgaacagacaatcaaattaaacagatcacatgcgtcagtcatcatcagtattattatcattaggaggtcaatcacgtgacatcaaaagaattcgctgaaattataggggtatcacagtccaccatatcgagagcgttaaacaacagcagccagatttctgtggagcggcgcgagtttattcagaagaaagcggaggagtacggtttcgttttgaacagtcaggcgagaagcctaaagacaaaccgcacaggcacggtggggatcctgtttccgaagcattttatcggcatgagctccaatcttggacttgcgcatttatatgatctggtacaggcggagctgagtaaatatgattatgatgtgatggtcgtctatgatggggaaaaacagaatggcctctccacctttgaaagaatgattaagatcgggaaagtggacggatttatcatttttcgaatggaatccagcaaaaaagacctggaactgataaagaagtataaggttccctgtgtttatctgcttcatgcagaaaaggccggctcctatggcagctgcctctcagactgtgaatacagcggatatctgatcggaaaactgttcggaaaatataaggaatataaaagcttttacatcaatgtaaaaacctccgcggaatcgaaaacgagactggccggatttagacgcggtctgaaagaacgcggcgttgttatggataaggatgccgtatggcagagcgagttgtcagtaaaatccgcatacgaatgcattatcaataatcaggagacgattaaggcgagaaaatgtgcgatcctggcattcaatgatacggttgccctcggcgttttaaatgcatgcagggatctggggctaaaagtgccggaagacgtgcagatatcaggcgttggaggtctgccgatcatcgctgaaattgcgccggatcttaccactgtgaatgtgttccatgagagaatcgcctccatgggatgcgagatgcttcgctctgcgattgttcatggtgcccaggagccgattcataccgtgatcaggccggaactcgtactgaggggaacgactcttcggtaattctttgtgctattcgcataaaaaatcacgataaaatgtatcaactatgacaaaattgaataaaggtgttgacaatgactttaccgggagctataatttaaccatgcaacgaacgcatacgtatgcgtaaaactcacacaaacccaaaggagagggaggattacaatggttagattcggaaagaaagtattggcagcaacattatcggcttctatggttctggcgatgacagcttgcggttccggcagttcaagtaagaccacagagaaggcggcggagaccacagccgcagctgagagtgcaaaggaaaccacagcagaggctaaggaagagactgcggaggagactgcgggggcggtcatgccgaaagcatcaggcgagaagctggtgatcggcactctggcaaactgggtgggacttccggcatggtatgcctatgcggaaggatattatgaagaggtaggacttgatgttgaaatcgtaaactttggttctcaggggaccctcgtcaatgaagcgatggcagccgacgaatgtgatattgccgtatccggtatggcttctgtatatgctctgtccaccggcatgtataagtatatcggggacggatgtctgacgatcagcggtgagacgctttatggccgtccggatgatgcggtctgcaaggccggcgcggatgcgaacggtgtctatggcagtgcagatgcattaaaagatgcggttatccttgggccgatgaatacaactgctcagatgaacgccattgcatatatgcagtatttcggcattgatgcaaattcctttacttttacgaacctggattactcctctgcgctggctgcatttgaatccggtcagggcaatttaatagcagtgaatcctacttatgccgctatccttgcagcagatggttatgtacaggtttctgattttacacaggtgtcgccccaggatattattgacgcggtctattgccagaatgaggtggccgagaagcgcccggaggatgtggagcttttcctgtactgctactataaagcatgtcaggatatgttaaacaatcaggataacagagttgcggtagcctataaatggtatgtagatgagggacttgattataaagagcaggatgtcatcgacgagtgcagtcttaagagctattttactctggattcggtggacagcggcgactatatgctgggaagctttatgaattacgctgcagaattccttcttaccaatgaaaaggtaacagaagatgatgtgaccaatgtgaaggcaagtattgataacagcttcattacttccataaaaaagtgggcgtcagctgagtagtcaggcgctagtacagcgttgcataagttccagtgaattctgcgctcgctattcacgccaggaccacgcccgcgaagctaaccgtagggtccactacgccgtcgcttcgcggacgcgcccctgacgcaaatatcaagcacacaattcaccgaaacttacgcaatgctgtactagtggaaataaaactttgagaatcccggtccttttgttttgtaatatttttgcgataactaaatcttacaggaaggggaccgggatttctttgtaatatcggcagagccgatggagtactgacgggataaaaccgcagaaacttgaggagtaatacgattgatttaaaatggagaaagttcaatgaaaacgaagaagaaaatcagcaaatatacaattatttcctgctgcacggttctgttcgtgctggcagcctggtatgtctgcattaatgttctgcatttaaaacaggaaaccgtctttccgggaccgctcactgttgccaaaacatttgtgcagaaaatgacttcgaaagtaccggatggggcgacgcttccgacccacctgatgggaagcctgaaagtagcgctgttcggatactctctgggagtgctgttcggggttccgatggggatcatgatggcctggtttaagtgggtagaccgtcttgcaagaccgctgtttgacttaattcggccggttccgggccttgcctggattccgatgtttattcttcttttcggtatcggcattttaccaaaggccgctgttatttttctcagcacctcggtcgcatgcatcgtaaacagctacaccggaattaaacagacgaaacaggaacatctctgggttggagatgtcttcggattttcaaatttgcaaaaactatttaaaatagcgattcccactgcactgccgatgatctttaccgggctgagagtggcgatgggagcggcctggatggctctcgttgcggctgaactccttgcctcctccgtaggcctcggatatatgattcagcagggcaggtacgcttcaaaaccggcgcttgtatttgtcggtatgatcatgatcggaattgtcggattgctattcgatacaattctgcactggcttgaagtaaaagttgcgaaaggaatgaatgcagaatgaatgaaaatacaaaagaaaaattattgtcagtcatatgtgcggttatttcgattggagcatttttgcttctctggtggttcgtgacgcattacacagacttgtcgaagcttttgccggaccccgttgtggtgctgaaggcgaccttcgagtactgtatcggcgtagtgggtaaatacagtcttatcattcacatgctgagcagtctgaggcgagtactgatcggcttctgcctgggatccctggccggtgttatacttggcttgctgatgggaagatatctccttgccagggcaatttttaatccgattttcagatttatacgtccgattcctccgattgcctggattccgatttctattatatggtttggccttggagaggaagcgaaaatattcctgattttcttggcggcttttgccaataccacattgaatgcgatgaccggggccatgaatgtcgatcccgaagtgattcatgcagccaggatgcttggggcaaaggaacgtcagatttttaccactgttgtaattcccgcatcggttccggctatttttgcaggactccaggtcggaatatcgtctgcgtgggcaagtgtggtggcagccgagatgatcaaggcagagaacggcctgggatggattattcaggccggtatggataacaacaatatgacccagattctggccggaatcattatgattggcgttgttggttttttgctggcttatattatgcgtaaagctgaagaggtgatgtgtcgatggaacaagagcggaagataaatacagtaatagaatgcaaaggcgtctgtaagacatttgatacgccggaggggaaacacgaagtcgtgcgcgggctgaattttaccgccaaagaaaatgaattcctggtcctttttggtcccggccagtgcggaaaaacaaccattatcaatatgattgccggctttgaaccggccacagagggaagcataaccgcttccggcaagaaggttgaacggccggatgtctccagaggcgtagtatttcagtccatttcactatttccctggatgacaaccatgggcaatgtcgaatatggacctaaaatagccggagtaaataaggaagaacggaaaaaacgggcgcagaaatatatcgacctggtaggacttcagggctttgaaaattcctatcccgttcagctctccggaggtatgaggcagcgtgtcggcatcgcgagggcatactgcaacgagcctgatgtaatgctgatggatgagccgtttggcgcgctggatgcgcaaaccagatatttaatgcaggaggaactgcagagaatatggagcgcagagaaacgtacggttattttcgtaaccaataatattgaagaagcactgtatcttgcagatcgaattattgttcttaccaattgccctgcaacagtaaagaaggaatatgtcatcgatcttcccagacccagaaatttggtttcggaacaattcctggcgcttcgtaaggaaataaccggcatcctggatagatgggaggattaggtatgagtgatcagataaaagtacaggtcagacacctgacgaagaaatttggggatctgctggttctgagcgatgtgtcttttgacgtaatggatggcgatttactttgcgttgtaggtcccacgggctgcggaaaaacaacctttttgaacagcctggtaaatatttacgatactacctccggcgaaatcctgttggatggacagaaggtggatacgaaaaagcagaatatagcgtatatctttcagggaaattcaaccatgccctggctgaccgtagaagaaaatgtgggctttggactgttgtataagccgctttccgatacagaaaagaaggagcggacagagaagtatctggaaatcgtgggattaaccaaatacagaaaatattatccaaaacagctctctgccagcatgctgcagagggtgagcatcgcccgagcattcgccacggagccggaactgctgctgatggatgagccgtatggacagctggatattgagcttcgcttccggctggaggatgagctggtgaagctgtggcagttgacgaagacgacggtattatttatcacacataatatcgaagaggcagtctacctgggcaataaaattatgattctgacgaacaagccgacaacagttaaaacaacattgatcaacgaacttccgcgtccgcgtgatattgcggatccgcagtttattgagcttcggaataaagtgactgaacttattaaatggtggtaaatatggaaaagaagagaaagaatattgtctggttctgtacggaccagcagaggtgggataccattcacagccttggcaatccctatatacatacgccgaatattgaccggctggtggaggaaggcgttgcatttaccagggcctatacgcaggcgccgatctgcacgcccagccgcgcctgctttttaacgggacgttatcccagaacgacgaagacaatctttaatggaaatgaaaacttctcgaaagatgaaaaactggtgacaaagctgctggctgatgaagggtatacgtgcggccttgcgggcaagcttcatctgacatctgcggaaggcagagtggagaagcggtgtgatgacgggtattcctatttccagtacagtcaccatcctcataatgactggaaggatggaggaaatgattatcaaaactggctgaatgaaaaaggtgtccactgggaagaaatctacggcggcaagtttatgactatggctacgtggccgccgcaggcaaatcccgcattttcggggaagcaggtgggcgttcccgcacagtaccaccagactacatggtgtgtggagaagacgatcgattttattgagagcaggagaaataccggagaaccgtggctgatcagcgtgaatcccttcgatccccatccgccgctggatccgccgcaggaatacaaagaccgtctgagcatagaagatatgccgctgcctctctgggaagacggtgagatggaggggaagcccccccatcagcagaaggatgtgattcaaggtggacaggatggccaggcggagcccataggctcgcttacagatgaagaaaaacgggagcatttcagagattactatgcggagatagagctgatcgatgaccagtttggaagactgcttgagtaccttgaccgaaccgggcagcgtgaggatacgattgttattttcatgagtgatcacggtgaaatgagcggcgatcatgggttgtattggaagggcgcctatttctatgagggcctcgtgcatgtacccttaattatttcctgcccgtccgtcttcaaacagggattacggtgcgacgcgctggtggaactcgtagatatcgccccgacactgatggaagctgccggactggaagtcccttattttatgcagggaaagagtttttatggtatactgacaggagaggcggatccccatcatttcaaagacgcagtttacagtgagttttatcactgcctgagaggaactcatgaagacattgatgcgacaatgtattataatgggagatataagctggtaatttaccatggaaaagagttcggagagttgtatgaccatgagacggatccgaatgaattccataatctgtgggataaaccggaatatgagacgtttaaaacagaactggtgaggaagagcttcgatcataccgtactctgcaatatggataattccatgcaccgagtctatggtttctgataaaggagatggagagatgagtcagaaaccggtaaatattgtttggttttgtacggatcagcagcgctatgatacgattcatgcgctgggaaatccatatatccatacaccgaacatcgatcgattgatagaagaaggggttgcatttacccgggcctatacacaggcgccggtttgtacacccagccgttcctgttttttaaccggaagatatccccgaacaacgaaagcattttataatggcaatgacaattattcaaaagatgaaaagctggtgacaaagcttctggccgaatccggatacgtttgcggcttatccggaaagcttcatttgacttctgcacaggggcggatggaaaagcgcacagacgatggctacagctatgttcaatggagtgaacatcctaacgacgactggccgggcggcgaaaatgattatcaaaactggctgaaagagaaaggccttcgctgggaagatatctacgggggaaaatatgccagtatggcaacgtggccgccgaaaccgaatcctcattttacaggtaaaacggttggcgtgccggccgagtaccatcaaacaacctggtgtgtccaaaaagcgattgagtttatcgaacagaaccgcagcagcgggaaaccgtggctgatcagcatgaacccttacgatccgcatccgcccctggatccgccgcaggcctacaaggacagattaaacattgaggatatgccgctgcctttatggaaggatggggagctggacagcaaacctccgcaccagcagaaggattatatgcagggcggccaggatgggcaggcggaaccgtacccgacgctgacggaggatgacaggagagaacgttttcgtgattattatgcggagatagagctgattgacgatcagtttggccgtctgatgaattacctggaggagacggggcaaagggagcagacgctcgtgatttttatgagtgatcacggcgagatgaatggggaccatggcctttattggaaaggcgcctatttctatgaggcgctggttcatattccgcttattatgtcgtgtccgtccctgtttaaaagcggcttaaaaagtgatgcgctggttgaacttgtggatctggctccgaccctgatggagcttaccggacaggaggttccttattatatgcaggggaagagtcttcttcctattctgaccggacaggcggatccccatcatcataaagattcggtttattcagaattctatcactgtctcctgggatcgcatgataatatttatgcgaccatgtattatgacggcagatataagattgtaaattaccatggaatggagtatggagaactttacgaccatgaaacggatccggaggagttctgcaatctgtgggataagccggagtacgccttgaaaaaagctgagttgatcaaaaagaattttgacagtgccgttatgaaaaatatggaccggtctatgcatatgattaatgaatactgacaggatatgcagaccagaggagatgctgatgaaacttactttagaaggaataaaggacaaacaactatggagtcaggcaggaatcgaactgccatcctatgatttggaagaactggcacagcggacaaaagaagcgccagtctgggttcattttggtattgggaatatttttcgtatttttattggcagcattgcggatcgtctgatcacagacggattgatggaccgcgggattgtctgtgtggagacatttgactatgaaaccatcgaccggatctataagccctacgacaatctttccctgtcggtgatcttaaataacgacggaacgacagaaaaaagggtattcggctgtttcacggaagcacggaaggggctgcctgacgggacggaagacagacagcgcttaagagagatctttgccaatccgagtctgcagatggtttcctttacgatcacggaaaagggatatgcgctgcgcggtgcggacggacagtattaccgctttattctggacgatattgagtatggtccggaccgggcagcaggggctgttgcgatcatagccgccatgctccttgagcggtatcgggcgggggcgaagccgctggcgcttgtctccatggataactgctcccataatggggagaagcttcgcagcgcagtgctggaaatcggacaggaatggaaaaagaagggctttgtcgatgaggaatttttaagctatatcagtgacgaggagaagattgcatttccatggtccatgatagataagatcacgccgaggccgagtgaggcggtgagagcgatgcttcaggacgccggagtggaggacatggatattgtgatcaccgataagcagacgtacatagcgccttttgtaaatgccgaagaaccgcagtatctggtggtggaggaccatttccccaatggacgtccggctctcgagaaggcaggggtttatatgacaagccgcgaaaccgtgaacaaggcggagcggatgaaggttacggtctgtttaaaccccatccataccgctctggcgccttacgggtgtatgctgggcttcaacctcttttctgatcagatgagtgatccggagctggttaagctggcggaaaaggtggggctgcaggaaggcatggagtttgtggaggatcccggtattatttcaccgaaagcgtttattgacgagtgcatcaatgtgcgtttttccaatccgtatcttggggatacaccgcagcgtatcgcagtggatacttcgcagatggttggaatccgctttggggaaaatatcaaggcctgcgttcacaaatacggtgacgcgaaaaagctgaaagggattcagctggccattgccggctggcttcggtatctgcttgctgtcgatgacgacggcaaaccgtttgcgctttccccggatcccatgatccttaagctgcaggggcagatggccggaatcgcatggggcgatccggacagcttaaaagaccagctccggccgattctgggaaacgcgaatattttcggtatcgacctgtatgaggcgggaatcggagacgatattacggagatggtgcgggaagagatcgcgggtaagggggcggtcagagaggtgctgagaaagtatttgaaataagagtactgtttgcagcaatttaacaaaatcaacgagaattctcccggcctctataggtgggagatgaatcgcaaaaacaaacttagcggcagtggagggcagatattccccactgacacgaggtcaaaacaatccggacaaccggataaaatggcagtatagttattatgccattctgggttttgtatactgaactcagaatgtggattgaaataatgtatgtgcggtaaggtgttttgttattgtgaagtgaggaggcagtcagattaattctggctgcctttttaatcttttttgggggatttgaggtaactgctcatttgatttacaaaaagctgcaaaaaatcttcaaaatcttcaaaaacctcttgacttagagttaactccaggtagtacagtggtaatacaaaaaggaaggagaacacgatgaaagcagtcattatctattattcctacagtggaaatacgaaaaaaattacggaaatggtacagcgcgagacgggatttagggcggcggagctgaggaccgtggtgccctattcagagaactacgatgtggtggtggatcaggggcaggacgaagtgaaacggggatttatgccggagatcctgccgctggaagtgaatcctgaagaatatgacaccgtatttttgggaatgccggtatggtggtatacgtatgccccggcagtaaagacatttttggcacagtataagctggccggaaagacgattctgccatttgccacaaacggcggctggattggccataccgcaaaggacataaaagttgcctgcccggattctgagattggggagattttaaatgtccgtttcgacggcgcgcggcttgtaactccggaaaaaaggattttggaatggataaagaaagtgtgagaggtacagcagatgaaaatagtaatgaatcaggtacacagcaccaataaagagacgggtaccgtatacatgacaaaggatatcagcccggaaggcctgatgcgtacttaccgggcattaggcatgaaggcagcgggaaaaacggctgtgaagatttccagcggagagccgggaggccatcatttcctttcattcaagctgatagagccactggtaaaagaggtaaacggcacgattgtggaatgcaacacggcatacggcggaagaagggccgataccaaatctcattgcaaggtaatggaggagcatggcttttcaaccatcgctccatatgatattatggatgcagatggttccattgctattccggtggcgggcggtgttcatttaaaagaggacatggtgggctcgcatctggcaaactataattttatcgtaaatctggctcattttaaggggcatgccatgggcggcttcggcggtgtgcttaaaaatatgtccattggtattgcatcagctatggggaagagtctgattcacagtgcgggaaaggaaacgaccgggtttggaatcgacacacctcaggatgatttcctggagtccatggcggaagcggccaaggcggtggccgattacaggaacggttccatcctctatatcaatgtgatgaaccatctctcggtggactgcgactgtgattctcacccggctccgccggaaatgaatgatatcggaatctttgcttccttagacccggtggccttagaccaggcctgcgtggaccaggtctatgatgctcccgacggatcggcactcattgagcgaatcgagtcacgccacggaatccataccgtggagcacgcggaagcaatcggagtcggaacgaggaactatgtcttgtatacactggatgagtgaaactgaaggagagataaaatgaccatagcagaggtgagcaaaaaatatgatatcactgcggatacactgcgctattacgagcggattggtctgattccgcccgttccgcggacgaaaagcggaattcgtgattatgacgacgtttcttgcggatggattgagctaatgatctgcatgaggaaggcaggagttcagattgaggcgctgatcgagtatgtagccctgtttcatcagggagacttaacgattgatgccaggaagaatcttctgattgaacagagggaacagctggttgagcggatgaacgccatgcaggtctcattagaccggttgaatgacaagatcgaccgctacgaaaaggggcttatggtgacggagaaaaggctgcaggagctgtaaagtttcatttcaatttcataaataaataaataaaaaaaggccgcagtccgttgcaattgcaacatactgcggccgctttttatgataagctgattacgaattcaagagaaactgattgtagatcttaaaaagcaggaaatatagaatggaggaagtacaatatggagaacaagatgttttgctatcagtgccaggagacggcgggatgcgccggatgtacaaaatcaggtgtctgcggaaagggaccccgtacggccgctttacaggatatgctggtgtgggtgacaaaaggactttcagaagtggcggtacgcatgcgggaggagaatcagaacgttccggatggggtaaacagccaggtggtggaaaacctctttatcacgattaccaatgccaattttgacgatgaggcgataattcggaagataaaggaaacgctggaaatgaaaagagagctcgcaaaaagcctgtcaggaacggaacccatgtctccagcggctctctgggatgacgcggagcatatggaagagaaggcgaaaagcgtcggtgtgttatccacggaagatgaggatatccgcagtctccgggaactgattacctatggtcttaagggaatggcagcctacttaaagcatgccgcggctctggaggcgaaggcggaaaacaggaacacggcagagggaaaaagagacacggcggcatttttagagaaggcgctggcggcgactctgaatccggcgctgaccgcggaggaactgacagcgctcgcccttgagaccggagagtacggagtgacagccatggcgcttctcgatgaggcaaatacctcctcatatggccatccggagattacggaggtcagcatcggggtcagaaagaatccgggaattctcgtatccggccatgatttatacgatctggaacagcttctggagcagacggacggaaccggcatcgatgtgtacactcattcagagatgcttccggcgcactattatccggcctttaagaaatactctcattttgtgggaaattacggaaatgcatggtggaaacagaaggaagagtttgaggcgttcggcgggccgattctgctgacaaccaactgcctggttccgccgagagacagctataaggaacggctctacacgaccggagcggttggatatccgggatgcaggcatatagaagcgggcgaagatggaaagaaagatttctcgcagattatcaatcaggcaaaacaatgtccaccgccggtggaactggaaacaggcagtattgtcggcggattcgcccataatcaggttcttgctctggcagagccgattgtagaagcagtgaaaagcggagccattaaaaaattcgttgtgatggcaggctgcgacggccgggcgccatcgagaaattattatacggattttgccaaagcgcttccaaaggaggcggtcattttaaccgccggatgtgcgaagtataagtataacaagctgaatcttggcgacatcggaggaattccccgtgttttggatgccggacagtgcaacgacagctactccctggccgtgatcgctctgaagttaaaggaagtattcggcctggaggatattaacgacctgccaatcatctacaacatcgcatggtatgagcagaaggcggttatcgttctgctggccctgctttccctcggcgtgaagaatatccacctgggaccgacgctgccagccttcttatcgccgaatgtggcgaaggttctggttcagcagttcggaattgcaggaattggtacggtggaagatgatatgaagttgttttttgaatcataagcatgaaagtgaatcatacagagaaaaagccagggacatcaaatacctggctttttttcaacctgacgtgtcagggcgtgtttgaaaatgcattcctgccatctgcatgctctagaacaactgatttcggaattttctgcggtacacagccggcgtcagatcggtatacgccttaaactgccggtaaaaatggacctcggtggagtagccgcacaactcggcaatctgttccattggcaggtctgtagtctcaatcaaatctttcgcataatcgattctcatctgaatgtaatccttttgaaaagaaaccccgaataactccgtatagagatgctggaaatgggacttgctgattcccagccgctttgaaacatcgtcgatggacagtggatccatgagcgtgcttttcatggaaattcgtatttcctgcagctttggaaagtacggattataatatgcggctaaatctttctgctgataggcgatgagaaggtgattcagcagcacgttgaccagacagtcgatattctccgtgcggtactgagaggtcgtgtaggcgttttcccataagagctgccggatgtagacggaaaataactcggcatcatcgactcggaaaaatgtgtttgtcgctaagattccccgcagcggaaaaatgtcttcttcggcggcgatgtgaagccagtcatccatatattccccatagggattgctgtaggaacacggcgtatgcggagcgaggataatcgcctggttgggcgaaagggtgtaatcctgtcgggcgatctgaaatacggcaggtgttttcacgatcagcagcagataattgttgaggccatccggatgtgacatgaaaaatgaactgggatggcgggtgttgcagccgcctttgataatctggtacatttcttgtcctttactttccctgtttgcagaaaatgttagtttttgagcgcaatacgctattaaaatcaacctgtatataatgtaatatgaaaaccataaaaagtcaataaaggtggtaattatgacagagaagacgcaatacctgcaggaagaggcagcacaaatgttacagaatgtgactgtaaaaacagcctatatgtgtgaaagaaataaaaacgggattccctataccgtaaaggatgacggtttttataataacctggattacatggatgagaatccggatctcgggatcaactggtggacaaacggattcttcggcggtattttatggcagatgtatgtgaaaaccagggatcaaagctatctggaaatggcaagggtacaggaaaaaaagctggatcagtgcctggagctgtttgagggaatacaccatgacgccggtttcatgtggctgctgaccgcggtcgccgactacaaactgaccggatggaaggaagcgaggatcagagggcttcacgcggccacgattctggccggccgttataatgtgaatggaaaatacatcagggcgtggaacggtcccggcggaagggattacggaagcgtcattatagatagcctgatgaatatgtccctgcttcactgggcgtatgaagagacgggggatccccgattccgggcgattgcagtctcccatacggatacgatcgcaaactattttgtgagagaagacggatcggtaaaacatattgtaaaattcaatccggagaccggggaggcggaagggtccctgggcggccagggatacgggcacggttctgcgtggtcgaggggacaggcctgggcgctgtacggatttaccaatgcgtaccgccacacgaaacaggattcatacctggagctggcgtgtaagacagccgattactttcagagaaatctgcggacgggagatgcagccccgattgatttctgccagccggcagaggagcagtacgaggataacagcgcggcctgtatcgcggccagcggctttttagagcttgcctcgttgatggacggcgagcctgccagacagcagcagtacgcggacacggcctggagactgctccgcagagtgtatgagaaacgttgctgcctggactgcggcagggatgagctggtactgcagtgcgcggtatcgtaccgggaacgggaagacggcccccatactttgatctacgctgattatttttatctggaagcattgttgaagctaaggcagcaagccttacaaatatggtaatccacaaggaggaaaatatgaaaaagaaaattttaagtgcggcattaggactggtcatgatcctttcttcggtactgaccggttgcgggggcagtggaacgaaagaatctccggaacagcagactgcggcttctgcggaaaaacagacggatggaacggtacaaaacacagaaaacagcggaacagccacccatttaaagtgggcggtgtgggatatcagcctgattacctactggaacgacctggctgacgcttatatggaaaagaatcccgacgtggaaatagaacttgtcgattttggatctactgactattcgaatgtgctggcaacagaactctcgggaagcggcactgattttgacattgttaccatcaaggatacgcccagttatgcgacgcttgtggaaaaaaatgtgttggactccctggacagttacatagaaaaggatggcgtcgagctggcaaaattcaatggcgtcaccgatcagatcctggtaaatgacagtctgtatatgcttccattccgaagcgatatatgggttatcttctataataaagacgtttttgatgcaaagggcctggactatccgtctaatgatatgacctttgaagagtacgatgcgttagcccgtgcgatcgcagatgattcgtttggatccgaggtatacggttcccattaccacacatggaattccgcggtgcagttatttggaattctggatgggaagcacagcgtactggacaaaaattacgatttcatgattccctattataacatggttctggcacaggaagacgatggaatctgtatgaaatatccggatattaagacggaaggccttcattattccgctgcatttaccggcggtaatatagcgatgatgaatatgggaagctggtttgtgaccacgatgattaataacttaaaatccggtgagtttgacgcctctttatgcggaaactggggaatcgctaagtatcctcacgcggaaggcatcgatgcggggactacgttgggtgcagttaccggtctctctgtggtgtccgaatcgcagaaaaaggacgcggcctgggattttataaaatgggtaagcagtgaagagggcgcgctcatcctggcagccagcgggaatttcccggctatctcgaacgatgagataacggcggcgatcgcttccattgacggtttcccccaggatgaacagagccgtgaagcgctcggcacggtaaccgtgtatctggaagctccttatggaaaagatttatccgcaatcaacccgatccttggtacttatcatgagatgattatgcagcgtgagtgcacggtggaggaaggcatcaaaatgatgaatgaagaaacttctaaaatcgagtaatggaggtttgctatggcaagacagaaagcagtggagatgtccgcatcagttaagaaacgaaacagaaggcgtaatttaaccgcctatctgttcattgcaccaaattttgtgggatttgcggtattcacgatgatccccatcgtggttgctgttgggatgtctttttgcaaatgggatgggagcaatcctgctgaattcatcgggctggataattttatcagccttttccgggatacattttttgtgaattccctgttcaatacctttttatactgcatcggcacggtgcccctgacgttgatagtcgccctggccctggcagtactcctgaaccagaaaataagaggaaggtccgtattccgggtggtatcctgtatcccctatgtcagctctataattgcggtgacgactgtgtggcgtatgatctttcacccggcgaaggggccggtcaacgcgctcttatattacgcatttcaggtgccgaagggagatttgccgcagtggtttaccggacatttaatcattatgtcctatatcctgttttctctgtggaagtccatgggatattacatggtaatctatctggcgggactgcagggaatctcgggggaactgtacgaggccggcaatctggacggagcgaacagctggcagaagtttcgatatattacgtggccccagctgcgtccgactacattttttgttattatcatcatgacaattgcctgcttcaaaatctacgatacagcggtactgcttgccggcggcggaaatatgtctacctcctccatggtgcttgtgtccttcatttatcaggaggcatttaccaaatggaatatgggctatgcaagcgccgcggcgatcattctgttcctgattgtccttcttgtgaccctgttccagtttaaaaatgagtctaagtacaccaatgactagcaggaggtcgtgcaatgaaaacaatttctttcagacgaaatgtaaataaagtgctgctctacgcatttctggcgctcgttgtattggtaacgatactgccgtttatatggatgatatccgcgtcgatcaaatcagaccgtgaagtatttcaactgactccatttgtcctggttccggaaaatccgcggtggagcaattacgtaaaaatatggacgaagattccgtttgctgtatttatccggaatacgatagtattgaccgccgcggtgaccattttgcagctgtttaccagttcctttgccgcgtatgcgtttgcaaagcttgattttgcaggaaaaaagcagctgtttctggcctatatctcaacgatcgccatgccgtggcaggtgtatatggtgccgcagtttctcatgatgcgtaagatgggattgaacgatacgctgctggccatggtcgtattacaggcattttcggcatttggcgtatttttgatgcggcagttttatatgggaatcccggattccctgtgcgaggcggcccggatcgacggcatgagcgagttcaacatctacagcagaatcatgctgccgctgtccaaaccggcgctggctaccctcacgatctttacgtttgtcgcaacctggaacgattacctgggaccgacgatttatttaaagagcgagtcgaaaaaaacaatccagattgggcttcagcgttttatcgggcagtattccagcgaatatggactgatcatggcggggtctgtcatatccctgattccggtactgatcatgttcctgctgctgcaaaaatactttgtggaaggaatcgcaacctcgggtgttaaggggtagaagggggtacaggatgaaaaaagaagaatttttccggacttattaccgtccggcttttatggaaacggcagagcttgccaggaagctgaatcaggaggaggcggagcatgtgcttcgaaccgccgacgcggtaaggaggcacagcttcctcttcgatatggaatgggacatggaacggacgtatgaaccggtggagtttggtgactgcgtggactgggagtatcggccgggagatgatccggaatttacatggcagttcaaccggcatcgttttctcatttgcctgggccaggcgtacttaatgacaggggatgaaacgtatgcggcgtgtatgctggacctgatgcagcaatttatccggagccagagtgatgtacaggaaaaaaggcagactacctggagaattctggaggtcggcatccggagcgcgaactggatcaaagctctgtacctgattcagaatagccccctgctgacaggagagctgctggaccttttttatgagagtctgaagcagcacggcagaatcatcatggatgagcataacccgtattgttatgcgggtaactggggcgtattggaaaatcatggcctttatctgctgggcgcacttctgccggatgaatttggccgtgcctgcagggaacaggcagcagaagtccttgatcttgctctgcgcatgcagattctgccggacggtgtccagttagaacagtcgccgatgtaccactttgaagtgatgagatgtgtgctggaggttctgcttttcgcaaagctctgcggtcacaagctgccgaaaacgctgtcagaacgtgttcatgatatggcgatggctggtttggcgctgcggaaaccggatggctgccagcttacgatgggagacagcgacgatatgagtacattttctgcctttgcgcttgccgcgtatgtgttcgaagaccgcgtcttaaaatgggcaggcagtgaaaatccagggtttgataatctgtggctgtttggagcggaggggtatggccggtaccgggagctgacatccggagaaccgggttttctgtcaaagcagctgtatgattccggccattcggttatgcggtcttcctggcagagaaatgcggatatgctgcattttgatggagggctgctgggaaccagccatggccattccgacacgctgcacgtggatctgatcttaaacggaacggatgtgctggtggacccgggccgttatacgtatgtaaataaggcggagcggtttgaattaaaagggactaaggcccataatacggttgttgtggatgaccgggaatttgatgaatgggagaattcctgggtttcgcgcacggtgtctgctcagagcaggcagcggatggaggaaaaggaaggatgtcagtttgtgtgcgccgggcataccgggtatatgactctggaaaatccggtatgggtaaaccgaaaggtaatccatatatcgccggatatctatattctggcagatgaatgttataccagcggagctcatagctaccagcagtattttcattttgactaccgtggaacggttgcgttagaaggaaaacgggcggagtttcacggtggagatgcaaatgcggtatttttctttgatgaaaagtgcaggccggagctgtacagaacgcatcagtctctccactataataatatggtcgggaatcagagtatctgctgtaaatcggcgggagacggttttcattccatggtaacggtgtgcatcaaggacggcgccggtgaggattccgtacaaagagtcccggtcaaatcctatgtgaatcaggagatacagccggaggctattgcggagggatttaagatcagtcatcatgaaaagaagtatctggtcataatcggccatacggaaatgaaagggccggttaccctgtatcagatagaggaccgcatgggctgcggaaatgtgatcgtattcgatctggagcggggggcatatgaggggactgttttgaactggtagagatactggtaatgattctaaaggagagtctgttggagggatattgctttagtttgtgcgcaggtttttagatgtgaaaagatggattagacagctgtacttctgtttggtggatgtacggctgttttttgtataacgattcaaaccggacgcctcttgatgtacaattatattgaccagacaaattatagaaagaaggtgctctggagggaaaattagcaaaaaatcaagacaagtttgccgatagtttcaattgcgttttccaatcctttgtggtaaaattatctcaggtttttatgatattctgtttctaatttctatagagcaggcaattcagaaatttctttcatacatcccatagtgacaggcggcattggcttcaaaattgtgttatgacaaaaaacaaaaacattgagggcggtttgtaggcgcatgtcatgcaggggcatgtgctgaatgagagagacaaaatttacaaaaggggaagtataaattaatatggcatatagagcagaattatgggcagaagcaaaaaagaaatgcagactgggagaagaagaaattcgcatggcgaaagaaatgggcctgaatccgaaaagcctgataaaaaacatcccaagcccaaaacaacagtggaaggcgcctgtaaaagtctggatttgtgaaatgtatgcggaacggcagagaaaagcagagaacaaaaagaggataaaagcagttaaattggctgatatggctgagaactgcagggaagaggagcacgagaagagggacatatgaataaacatcaggtgttaaaacaatactttggttacgacgagttccgtgacggacaggagacgctgatcgacagcattttaagcggcagggacacattggggattatgcctaccggggcaggtaaatcgctatgttttcaaatcccggcgcttatgatggatggaattacactggtcatctctccattgatctcactgatgaaggatcaggtggaggcgttaaaccaggcgggggttcacgccgcctatttaaacagttccctgaccgcttcccagtattacagggcactggcctatgccagggaggggcgttatcccatcatttacgtcgctccggagcggctggtgacggaggaattcctggattttgcgcgaaatacgaagatttccatggtggcgatcgatgaggcccactgtgtatcccaatggggacaggatttccgtcccagctacttaaagattgtggagtttatcgaacggatggaggtacgcccagtggtcagtgcctttacggctacggccacaaaagaggtaagggatgatatcagcgatatcctgatgctgcgggagccgacagttctgaccacgggatttgaccggcctaatctctatttcggcgtccaggcgccgaaagacaagtatgagacgatgaagaattttctggagcttcatccggggcagagcggagtgatctactgcctgaccaggaaaaacgtggaggaggtctgtgataagctgcgggcagatggattctctgttaccaggtatcacgcgggattgagcgatgcggagcggcagaaaaatcaggaggacttcatttacgacagggcggctatcgttgttgcgaccaacgcgttcggcatgggaattgataaatccaatgtccggtttgtcatccattacaacatgccgaagaatatggagagctattaccaggaagcaggcagagcaggcagagacggggaaccggcggagtgtatcctgctgtacggcggccaggatgtgattacaaaccagctgtttatcgataataaccgggataatcaggaactggatgccgtgacccgtgccatcgtccaggagagagaccgggaacggctgcggaagatgacattttactgctttaccaatgagtgcctgagagattatatccttcggtatttcggagaatatggagagaattactgcggaaactgttccaactgtctgagtcagttcgagacggtggacgtgacggagattgccgtggaactcatcggatgcgtggggagcagcaggcagcggtatgggaccaatgtgattatcgatacggtccacggcgccaatacggcaaagatccgtcagtaccgtatggacgaaaatccccactatgcaaagctctccaaagtgccgacctataagctccgccaggtgatgaattaccttcagctcaaggagtatctgggcgtgaccaatgacgaatacgccatcgttaagctgacggagaagtcgaaggcggtactggaagaggaagagccggttgtcatgaagatggcaaaggagcaggaacacccggcaaaggtgaagagcgaaaaaggaaagaagagccggaaggggctggcggccggcctcggcggcgctcagtttacagagcacgaggaagcgctgtttgagaagctgcggactctgcgcgcggagattgcgaaggaggaaaaggttccgccgtatatcgtattctctgataagacactgactcacatgtgcgtggtgaagccggtgacgaaggaagagatgcttaaggtgaccggggtaggggaatttaagtatacgaaatacggagagcggttccttgtgtgtgtgaagaaggagactcaggcagaggctggggcagtgactggttcagaggctggggcagcgactggtctagaggctggtgcagcggccgggacagcggcagcgtttcccgattacagcggatacgacgacagtgatgatctgtactttttcagcgaggaagaggatttgccggactactcgctggaggcggctcttacggcatgggaaaacggaagtccggaaaaagcggatctgccgggagattcattaccggagaaggcgtcttcagccgagggaaagggaactaagaaaaggtcatcgaaaacgaaaacagaatttgtaatgacagaggagctggcagaccagattcactattcggaccgggtaacgctaagtgattttgtgggacagattaacgatttaagggacgatgaggccatgaagcgtctgactataaaatccgtggagcagaagctgatggaggagaagtgctgggagatacagtttttcaacggaatgggcagaaaaaagctgacggaagagggcggtaacttcggaattgaagcggagaaacggctcagtgaaaaaggaaatgaatatgaggtcctgtactatacggagaaggctcagcgcggaatcgtaacatggcttctggctggggatcagaacttatcctgagatcagaatttgtcctgaaatcagactttcttccagtatcagtaaaaatatatctttttcaacaaaatcctagcgtgagttatttttttaacacagtgtttgagctatgataggatacgagatgtgttaaaaaaataactattggagggtaacactgtatgggaacaaaagagaaggagcaaaagacgcttaacgggattcagtcggcggtgcttctgctgttaattgtggcggcagtagcggtctgtattcgttttaaggtcggcggaccgatgatcgggctgtttttcagctggctgattatctatgtattctgtattgtattgaagattgactatgagcatgtaaaagaaggagccttcgacgcgttgaaggtggttctgcctacgatgaccattttgatggcgatcggcgttctgatcggcacctggatggcgtcaggaacgattcctaccatcattgtgtacggtttgaaatcgatcaatccggcatttttactgacatttactctcgtttttacggcggtattaagcctggtgactggaacgtcatacggctccgcgggcagcgctggtgtggccatgatggcgatcggcaatgctatgggaatcaatccgggaatggtcgctggagcggtaatctgcggcgccatgttcggtgataagttaagcccgttttccgacacgaccaatctggctcctgccgttgcgggggcgaaactgggagaccacatcaagagtatgctgtggacgacgcttcctccgatgattatcagcattattttctttactgtagtggggatacagcagaccaacggcggctatgatccgggggatttgaatatttatattgattacttacagggcgcgttccacatcggatggaccactctgatcccggctattttgattattgcactcctgatgttccgggtaggcgcgtttgaagcgctgggaatcggtgcgattgcgggagcgcttgtggcaatcttcgtccagggcgttgatgttcggtcgatccttaaggtctgttatgacggatttaccagcgatacagacattgctgtgctgaaatccatcttaaacagaggcggtatggcgagcatgcttcagtatgtggctattatcacttttgcagtaggaatgggcggaatgctggaccgcctgggtgttcttaacaatattctttccgtctttatcaagcggatcaacagcgacggttccctggtgctggcaacgcttttaaccggatatgtaaccagtattgtcagctgttccagcccgatgtcccatgtactgaccggacgtctgatgcagcccctctttaaagagcgcggtgttgcgccgagaattctttcccggtgtctggaggacagcggcacactggcaggacctatgattccatggcatggctatggaatttacatggcgggaaccctgggggttacgtgggcgcagtatatcggattcgttccgctgttgtggctgacgccgctattctcgattctgtatggatttacgggaatttccatcaagcatgtgaacgatgaaaaaaaatagaacgcaggcagaaatgactgtgaacagttgacggatatttctcaaaggagttgctgaatgattctctgcgtgctacaatcgaatcaacaattataaaatagaattggagtatgtgcagtgagtaagatcgtaatattgacaggaagcaaaaacgaggggagggaatcaatactttcaggaagacgatatgcaactgatttacgagaaattgacagatgcagagattctggtaactgcatcgctggtctatttttacggaatcagtgcgcagctgaaggcagtcgttgagccttacatacaccgatgagaaataagtttaaaataaagaagatggtactgcttttggtcgcaggtgctgctttgcccttcgtttttgactcgataaaagtacagtatcagctgatccttgacttctttaacaaaattaacgggaattctcccagcctctataggtgggagatgaatcacaaaaacaaacttagcggtagcggcgggcagatatcccctactgacatgaggtcaaaacaatccgggcaaccggataaaatggtagcatagctactatgtcattctgggttttgtattctggactcagaatgtggattgaaataaactggagaatgcggggatggttctggtaagggaagtgagagagaaaggggaaatcaaggggaatcccgcactggaagaggcgcgcgaattgggcaggtcgctttgatggaaaatgcgttaggatagtaatggggaagatctgttgttgaggaatctgtaaggtggagggcccgctgctgttttggcagcgggcccctggtgccagcggcctcgcccccagcaacctcgcccccagcggcctctacctcagcggcctctacccccagcagacttaatcccggcagtctcagcaccgcgcctgtgccatcgccgtcagctgttccatgtcctggattaccgtctgatgccctcgtttgctcacgatccccatgtcctttagctttcccatgagccgtgtcaccgtgatcgtatggattcccaggtagcccgccagctcgctgtaggaaaaatccttatgtatgacgtaatgcgtgtcctcgtagatagccagttcggtcagggcacagcagaggctgacgaaattatcgccatcctggagcgcatagcagtgctttaacgcgttatcataatgggcgatcgctgtctcaaagagccagcggtagaaatcaggatgcgcctctacaaattcccggaaggtagaataggggatctgatagagtgtgcaggcggatttggccgtgatggaaaacgcgtaaaaggtatcgtcgggataggtacgggcataggccggtatgaagccgacaaaatcaccagggagaaaatactgatagatccgttccctgccgccgggagagacgctgtgcagggcgcagagtccttcttcgaggcagtatacgtatttgtccatatgggcacgattgtacagacagtcgtgcttttttttatgggtcagagtaccaaggccgcgcagggcgttcatgtaattcatattggattccatcataaggggtacctttcataaggactactagtgccgcccggcgtaaatataccatgcatagcacctgctctctacgccaggagcacgtctgcgaagctagccgtaggccccactacaccgtcgcttcgcagacgcagatatcaggcactattactcagttatttatgcaatgctgtactagttcgtgaaaaacttcactaagtgttcctattataccacagcaccaggcaaataaaaagaaaaatcatagcaactgatatttttttgaccgtgaagacagtgttataattttaacaaaataacaggaggggaattactatggaacgaaaaacaatcggctatgagcgaatcagccacttagtggagcgtcagtacgagcaggaaatggctatgagaaaagaactcgagggaggaaattataccgcagagcatccgtatgtggtggtaaatccttattttgtcaatccgctgacagccctgcttttattcaatacagagaaggaagaggcggtaacactgaccgttaagggaaaggaagctgcgggcgatatcacccacacatttccgaaggcaaaggaacagattctccctgtgctggggctttatcccgagtatgacaatacggttgtgatcacgctggaagacggaactgcttatgacgtgaccgtgacaacggaaaaaattgaaaatatgccgtatcaggcggattacatcaatacgacgagtgactacatgaatgggcagctcatgtttgtgacaccggcgggggattcgctggcgggcggctacgactaccgcggcgactgccgctggcatctggtggagccgtttatcttcgatatgaagcccgcggcaaacggccgcattctcataggctccaaccggctcctgaacatgccttactacacggcgggagtctgcgaaatggacctggtcggtaaaatatacacggagtaccgcattcccggcggctatcaccacgaccagttcgagatggaggatggaaatctcctgattctgactcaggagaaaaatgccgccacagcggaagatatgtgcgtgctggtggaccgcggaagcggggaaatcatcaagtcctgggattacaaaaaagtacttccgcaggaagctgcgaaatccggaagctggtccgaacacgactggttccataacaatgcagtgtggtatgacaaacgaaccaactctctgacactgtccggcagacaccaggacgcggttatcaatattgacttcgagacgggagaactcaactggatcatcggagatcctgaagggtggccggaagacatggtgagccgctatttctttacaccggcaggcgaaggagatttcgactggcagtatgagcagcacgcctgtatgatgcttccggatggcgatatcatgatgtttgataatggccactggagatccaaaaataaggagcattacagactcaaccgggacaatttttcccggggagtccgctaccacatcgataccgagaagatgacgatcgagcaggtatggcagtttggaaaggaacggaaaaatgatttcttctcctcctacatttccaatgtagaatactaccgtgatggttactatctggtacattccggcggaatggggtataatcatggtgttacatgcgaggaacttccggtttatatgaatctggaggatccggaatgcgtattaaagagcattactgtggagatcatggacggagagctgatgtatgaaatgcatctgccatccaattattaccgtgccgagaagatgagcctttaccgggagggaaagagtctcgatctgggaaagggaagagtcgtaggaaaactgggcgtcacgggcgaatttgatacggaggttccggcagaaagcaccggagaactgcttccggaatcctgtgaggcggtgctcacggaagaagacgaccgcatcattttcaaggccaagtttaagaaggggcagcttgtcatgctccagctggaaaaagaagatgatccggcggaaatccaccgttacttcatctcaaccagcgcacagaaattcctggccatgtgttccggtaccttcctgccaaaggacgacagggaagtgaccttaaatgtggacaaggaaggactaaacggcacatttgatgtgcgcgtgattatcgacgacgtcaagtatgagaccggactgaaaattccacaatcacgataggtggacgaaacagcgtactataattacaaaggggatgtgagctgacaatgagtaagaaaataggaaagatacttggaattgtggtgggaaatgggatttttgcgctggggctctcggcgttttccatgcccaatcatttcctggtgggaggcgccacgggaatcgccagaagcgtgcagcattttgcacatctggacgtatcagtgacggtggcagccctcaatgtggtcatgtttttgctgggattctacattctgggaaagcggtttgcgctgaccaccattgtcagcacacttgtatttcccgtgtttctgaatcagtttctgaagatcgaggcattcagccatctgacgaatgaccgcctactggcggccctgttcggcggtatgctgaccggactgggcctggggatcgtcatgcgtctgggcggttccaccggaggtatggatattcctccgctgattctcaacaagaagttccggattccggtggcggtgtccatgtacttctttgacattttcattttgctgtctcagatgatattttccaatacggaggagattctttacggcatcatgtccgtactgctgacctctatcgtattaaaccaggtgctggtattcggcgcgggcgatgtgcaggtgctgatcatcagccgggagtatgaacggatcaatgagattatccagaaggatttggaccgggggtccaccttcctgccaatccagaccggattcgagaagctggaccagaaggcagttctctgcgtgcttccgaaccgggaaatgagccacttgaaccactgtgtgcaggagatcgatccgaaggcatttatcattatcaacggcgtgcgcgaggtgagagggcggggatttacgctggataagcatctggtgtgatattgcagtgagaacagagagagcagaagcaaaacgcataaatcaaacagaaagccgggagtttaagacgttatctcaaactcccggctttctgccttctgttttcaatctctgtcattctacaaccaccggttccgagattcataatccgtatttactcccgtccctgtctcctcgaagagaagacggtttgcgaagtgatacgttacagtgcctctgccaagatacgtcccatccttccggcagaggttaaaataagccggaatgggaaggtcccttgctttcatggaagggctgaagagcatgacctcataaaccatttttccggatatcatgttttccagaatgtctgaggcgtttgggatcaggtgaaatggtacatctccctcggaaagcatcataacggccctgtaatactcgtgtttgtccggtgtgaaatctgcgtttgtaaaagtaaactctgcctgaaagagaccggccctctggtccaacggccgcatggtgactccatttgtctcgtaatccccggcaaacagccgaaattcggtgccgggactcttaaggcactccggtgtgttctcatcggtctcaataaagacctcggtaacgtcttccctcatatgaatagtgacttccagaacgtcagagggagaaaagtccttctggtttagaagctgtatcttcattctgctgtgatagaaggagggggtgccccggccttccagaaatatataagtccccttctgaactgccccaaagctctccgcttctccatttcccaggttcgcttcattttctgatactccgtactctttttcggattcggcctccttaagtgagaccttagccagatagaccttcggccgtcgaaacaggaaaaacgttccgtaaaggacgacaaatacgatgctgataaaatcaataccggatctgcgaagactgtttctgaccgcaatgtacaaaaacatcaggaacgtgatgatataaaaggcatatgcctgcagcagaggaacctcgcttcgccgggtacggtaccggttatagagcaaaatgaccgggcggtacggcttgccgcagtgttcgcaggttccgcgggttaaatgaggactctctatttcctggccacaccagggacagggctcagattttatcagcatggcgcctccttagagataaaacgcaagggaaaggtccatatttattcccccatagccggtcggatgaagaaccgcagaatggccagcgcgctggcgcccacggctccatccgcggccgcatacggcaggatttccacgttccctgcataggtgcggtccacgaagatcagctggcgttcgatgtagtccatcagttcgttctgaatgtcctggttgtcaaagagttggccgtgcagaaagatcttgcccgggttggtgatgatggcgatattggaaatggtgatgccaaggtattttaacgcctccgcgatatacattccgattacaggatcacccatggaataggcggtggtgatcgtctcgatggtgatcagggaatcgtcggggacgaggcttctcaatatggtgttcggcgtgtttttgtacagcagtcttgcgttgcggatcaggtggttttcgctggcgtacgtctggagacagccgtatttgccgcactcacagcggcggccgccctcgctgacgatggtatggccgatctcgccggccacgtagttctcgccgaggaacatctcgccgtccacgacgttggcgcagaacattcccatgcctacatggaaaaaggcgaagctgtccgggctttcctgcggggaaaagagatattcgccaagagccatacagcgtgcgttgttttcatagacgatgggaagcggaagctccttctcaatccgtttcgggtcgaaattctgccatgtcttccggttggtcacgagactggaggcactcccgttcatatggcccggaaccgcggctccgattccaacgatttcatcccaggaaatgccggactctgcgaccaggccctttacaccatcgataatggcgtcggtgattctgccggccagctcctcgttaaacggttccgcgtgctggaaacagatgcggccttttaagtcggtgatgcagatgaccagggccttctgggtaaactccaaaccgatgctgtaagcccggccgggtataatatcgatcagaacccgcttgcggcccgaggagccctcgtctgtggagacttctcccaactcctttacaaatccttccgaaatcagtgtggtaacgttcatggttaccgttgcgggtgtgatttcggtctcttctgcgatatcggttcgggcaatgggcgcgttccggtaaatacactccaatatccggctccggttggaggctttcttcttttttcccttatacatggctgcagcaacctcattcttccatcgttataattttaccagagcatgtggaaaacaagttccaaacaagctctaaagtgtgctgacgagcggttcttccagccggaaaccggtgtatttggtggaaacctcggtgacgcggtaaacatcgaggcaatcctgaaattccgtttcccgttcgcagaccatattctggaactgccgccagcattcctgtgcctccgattcgtttccctcggccagcttcatcagcgctttccctaatcgtaaactatattctcggtggtagtcaagatatttccaaaataaattttgcacggccgtgcggctctttgcaccgtctgtcccggacactggagtacaatccacgtattcgatcaattccctcatggctgccgcttctttcggatcctttcggttttcttttccgttgaagtagtcgcagctgcacagggaagacagttttgttaaataggaaagaacctgttcccagcccggcccgtaggcggcgctgaagtattcttccttcagctcttcaaacgttacatcctcatcaaagagcatacggcccatgacgtagcccggaaatgcgttagggagacattcccgaagctcctggcagctgatataaccgtccatgcccatctgtttcagcttccggatgtcctggccgataatttcggcgatgtggatatagccgaaatcgccgtagtgtgcacggcccagcggataatcgtatacgaagctttccccgtggaaatagttctgccacgatcttaagaacaccatgttctcatcgagtcccactggaagggtgattcggttccgttcataggccggaatgggcccgtagctgtccctcaactggtaggaatgctcgaaagtacggctgataggggcaaacatcaggagaaaacggtccggattgcggaaggcttcctctactggcggccacaggagctcctgatagagcagaaagacaatttttgcgtcgaggtgcagagtggtcagcttctcgtcgatccggttcagcagccgtatatactggtctgtgggcagctgggcacggcaggcctcacattcacagatgttgttaaattcatccgccagccacacatggaggtaggaaactgctggatgctgtacacagtattccgcaacccggtcggaaaaactttcgataacggtttcgttggagtagcagaggtttgtgttcatgggcactccgtgaaataattcccgcttcccatttacacaggcggcgagggagctggtctccggcggcagcggctcggtaatggctttccagtctgcacaggggaagccgagcacatccccggtccagccgtggcccgcctgatggagcagaagaccacgcgtttgaagcgcctcctcgatcttttccgtgaaggatgcggcagccgctctcgtaaattcctccggttttaagagcggattcatctcgtggtgataccagcgggccataaaggtatagggaagctggaactggagaaagaagctgttgtatcccatctttggcagccagtcgatgaagtccagaatattctccagtgagttggctccctcgatacagacgccccggtggcgcagcgcggctttcttccggcagcaggcggtgagctgttctttcttatataaggaaggtatgtattcatgcttctgaccgggagcgggaaaacggcagccaaggagccataagtatttgtagacgccgagaaggacgctgcggtcattgctacctgagatgattcctccggatgaggtgacgtcgatggagtaagcgtcctcgctgtttttcgggtttcccagcgaatcgagccgcagcgtgacgtcatccggcccgcaattctggttattaagtataattattgaatccgcaactatttccgccaggcaccgggacagctcctgtgcggcaaagacaacaggcgaaccggaatgtgagggatataaaatgttgatcgtcatggaaatcctcctgtaatgtatctggttgattgattatattttgtaactattataacaaaaagaaagaataaaaatatatgtgtaaaatgcacaataaaatttctttaaaagtgatataatgaacaaaaacactttatttattgattttatattgcgtgtcatgcggaaaagtgttatattgtaaccagcaaaagcaatgcctaattgattataaaaaataattaacaggaagaaagagagggctttccatgaaaggacagttttcagccgcttcgccggccagaacagtggaccgcagaaagaagcagagaaggcgcataaacatgtggtgctggatctttatgattcccacactgatactctacatattgtttcaggggtatccgatactctccagtattttttattcgactctggactggtcgggaatgacatcaagcgccctgttcgtcggactggacaactttaaagagctgttacaggacaaatacttttttaatgcggtggctaacagcttcaagtacatgctcatggccgttccgctgcagctggtgatttctctggccctggcctatatctttaacagtatattaaagaagggcgccacatttttcagaactgtgttcttcctgccagtcattacgacggcttccatcgtgggaattatcatgatgttcatcttcggcggaacaggctccatcaaccagtttctgtctctcttcggagtgaggggattaaactggctgggcaatgccaacacggcgctgatcgtggtagtgctcatcggtgtctggaaggattccggtacctttatgatctactggctggcggcgctgcagagcgtatcccaggacgtatatgaggcggcgaccatcgacggtgcgaacaagtggcagacatttctccatgtggtatttcctctgatcattccgatcggcggcgtgattaccgtactctgtatcatcagttccttaaaggtattcgacctgattcagaccatgaccaatggcggaccgttttactccacggatgtggcggctacctttgtataccggacggcctatgccagcagcagcggaatgccccggctgggttacgccagtgccgcagccatgacctttggaatcattgtcgtggtgatcggaacggtgggcaatgtggtgaagacggcgtttcagaagaaaaacgcgatataggaggggcatatggaaaaaacgattttaaacaaggtggggaagacggtcctctacgcagtcctggcggtggcttcatttctgtgggtctacccgtttctctggatgatttcggcttccttcaagacgcagaatgaatttttcgccagcgggctgaatctgattccccagtcctttaacctggacaattttatccgcgcatggaataatgcgaatttcggcatctactttaaaaactccatcatcgtaacggtatcggttgtggtgatcgtactcttaagcacctccctggccggatacgtcatgggccgctactcctttgtgggaaagggcttaatcatgaagatattcatggccagcatcacgatccccctggtatttaccgtgatcccgatctatgagctgttaaaaaacatcggcctgtcccagagtctggtgggtctgattctggcggagtcgggcggcggccatgtcatcttcctgatgctgttttccagcttctacgcttcgattccgggagagatggaagaggcggccaccattgacggcgctaatttcgttcagacgtatggcagcgtcatgttcccgcttgccaagccgatcatggtaaccgtagtgatcatgcagtttatctggacatggaactcctttttgctgccccttatcattacgcttaacaatccgtccctgcggacgctcgctgtgggactctacgccttacgaggcgaaaatgtcgttgactggaccggcatcgccgccggcgccagcattgcaatcgtaccggttatctgcgtgttcatcgcactgcagaagtattttgtagatggtatcgccggagctgtaaagagttaagaaaatcaaataaaggaggatatatttatgagaaaagtgaagagagcccttgcggcggtgctggctgtgcttatggccggatccttaagcgcctgcggagtcaaggtgcagacaaaggatgacgcgaatacgacggcagccgtgacagaggcaaaggaagagaccgaagccgtggatacgccgacagatgaaaaggtgacattaaagatcatcgactggagtgacagtacgaaggagcgcagggaggctttccacaagaaatttatggaggagaatcccaacgtcacgatcgagtacacggttctgactgcggatcagttcaaggagaccgttatttccgccatcaaggcggggaacgcaccggatttattcccgcttccctccggcatgaagctgagcgcggccctgaaggagaactggtttatgccaatgaatgattacgtatctgatgatttcctgaatacgttcgcggatggcgctctaaatgaaggaatcacgaccattgacggcaagacgtatgtgcttccggaatcggcaaatatcatcaatacccttgtattttacaataagaatgtgttaaaagaggcgggcatcgatgagagccagctcccgaaaacccgcagcgagtttatcgacgtgtgcaggaagataagcgacgccggaaatggcaagtattttggaatcatcgacagcggcgcacaggcgaaccgtctggagctggcgcttcgctccctggccagcctggatggcggcaagtgcagcgacatttcccagatgattctggtggatgggcagaatacgctgaattccgaggcgatgcagagtgcttttgatttctatgatacactggtgaaagagggatgcttccatccggataccgtttccatcaaggcaccggaggcccgcgcactgtttgcacagaatcaggcggcgtttatcattcagggtgcatggtgtatctccacatggcgcaaggataacccggatctggatttcggtgttatggcgcttccggcaccggacgatggaatgaagggcaagcttccttatatcggagcgcagccatggatgggaatttccgcaaactgcaagcatccggatgtggcggccaagtatttaaccgcgctctattctgaggattatcaggcgggcctcgtggaagacggtggatttgtatcggtaatcgacgcggccaacaaggctcatatgaccgacgacgttatgcttcagtattacaatttaaacaacgaggaagcggcgctggcaccagatccgatcgtgggaaatccggccacagctgacgtttatgcagaagtttccgcgatcactccgggactcggggaaatcgcccagggtattctggcgcagaacatcgattataagacggagttaaagacactttccgacaagacacaggaagagtggctgagagccatcgatgccgctaaggcgaagggtgccgatgtgtccgccgatgactttgaattcaaaaactggaatccgatggagaattatacggccgatctttataagagcagatagaggccggatgccataaaaaaagaataattttttgccattgctgcatactgttagaaaacgttccggtgggaagtgagccggaggaaacggagacggtatgcagcattttaatgaagtttattatgagccggagatcttgaattaccagttgggaaaggagttaaaggaacagcttaaagaactgccgtggattcccatagagagccacaaccgaattcccgagatgcaggagaagtccaataaggaattcgggcggatgaagcggaacctgatcattggaatcaggaagacgcataagtatgtggagaaccataaggtatccgattatctggttccctatacctcttccggatgcagtgccatgtgcctgtactgctacctggtctgcaattacaataagtgctcgtatctgcggctttttgtcaaccgggagcagatgatggaccggctgatcaaggtgtctttcagcagcgataccgagaaaaccttcgagatcggcagcaacagcgaccttgtgctggaaaataccattacggggaatctggagtggacgatcacacagtttgctgaaagaggacgcggccatattacatttccgacgaaatttcacatggtggatccgctgctgaacctggatcaccggggaaaatcaattttccgcatgagtgtgaatccgcagcccatcatcagcagaattgagctggggacatcatctctgatgcagcggatcgacgcggtaaaccggatgtgtgacgccggttatccctgcggcctgctgatcgctccggtcatcatcatggaaggctggaaagaggagtaccggacgctgcttgagacgctgagagaccacctctcgccgaaaatgaagcaggagatgtttctggaggttatcctgatgacatacagctttgtgcatcgggcgatcaacggagaggcatttccggctgcgccggagctctacgacaaggaactcatgacgggacgcggccggggaaagtactgctaccggccggaggtgagggcggatgcggagaaattcctgcgggaggagataaagagaacgctgggcgatgcggagattttatatattgcgtaaaatgaaacgtgtgaaatggcggaggcgtgctggcctccgccgtttttgtgctgagaaagctttgctgctgaagcagccgcgttccggtacggaggccggggaaatttcacaacaggattgctgacatggtttggctgtgttatactacatgggataaaagaaagcccgttttggcgggggatcgaatgacaggatgcaggactggaagggaattttgataaggatgaaacgaaaaaataagataaaatacgtgattttggcaggtgcagtgtcggcagtggttctgtcggcctgctcccatggccaaacggcagatatcactgcagcggagcagtcggccgtagaggaaacgcagaccacggagccgttgacggtctctgcgtctgaggccgctgctgccggtgccggtggagaagcggaagagggcggagaacatacgctggatggcagccggattattgccggacagagctttgatgtcacctggaagaactggggagatgtccgtttcgtttcctatgcgccgcctgccggtcgtgttcatgatgatgccgcgttctatttgacgaaaaatgatgagatattatatgaatttcctcaggcatgggatgagggctgtgtaccgtggaccttcgaatcggtggatatggtatcctttcgtgacattgacggtgatggaaatgaagatgtaatcgctattctttcgtatataacgggggcgggtccgcaggcggcggttccatttcccactacgcgaatctttatgggcgacggaacgaaatttgtaattgacaccgaactgtctgaagctgtcgatgaggcacacgccaacgagaatatcagcacgatcatggattttataaaaaaccggacagcccccgtcaagggggaaggggccgataaaacggcggaagccggaaccggtgcaaaaacggactccgccagtccggagagcggagccggtgaggacaagatgtatgagataaccgggattcgggaaacggacgcgagggcctttctaaagaaatttgtaggccatgtaaaggcgggagagaaggcggaagcctcccggatgatcgcatttccgaggaaagtgattctgccggaccaggaagtgacggtagagagtccggaggcatttttaacgtattacgatgagattttcacggaagactttaaggagcgcctcagtcagtttatggatgaggattccatctggtggaactataggggagtagccgtgggaaatggcgagatctggctgaatgaaagcgacggcgccctgtggattgtaacgttaaacagcgcggaggaccggacggttctgtatccgggagaaacggggattcaggccggataagggcgctggagcggcggttttgataagagaatatgaggagagaggaaggaacaaatggagaatcaggagcagacacataaacgcagggtccggtataaagggactcatccgagaaattataaggaaaaatataaggagcttcagccggagaaatacgccgataccgtggcgaaggtggtgagcaagggaagtacgccggctgggatgcatatctcgatctgtgtgcaggaaatcctcgatttccttcagatcaagccggggcagaaggggcttgacgccacgcttggctacggcggccatacccgggaaatgttaaagtgcctgcagtcggagggccatctctacgcccttgatatcgatcccatcgagcttgtgaagacacgggaacgcttacagagccagggcttcggcccggaaatactgacgataattcaggagaattttgcgaatgtcggccgcgtgggggccgaggtgggaccgttcgattttgtgctggcggatctcggcgtatcttccatgcagatcgacaatcccgaccgcggattttcttataaaaccgagggcccgctggatctgcggctgaatccggagaagggaatcacggccgcggagcgcctgcgtacaatcgacgaggaagagctgcggggtatgcttctggaaaatgcggacgagccatacgcggaggagattgccagagccgttgtcctggagattaaaaagggcaatccgatcgatacgacgacgcacctgcgccaggttattgagaaggctctctcggcagtgccggaagcggaccggaaggaagcggtgaaaaaatcgtgtcagaggacatttcaggcgctgcggatcgatgtgaacagcgagtttgaagtgctctactcattcttagaggcgcttccgggcgtgctggcgccgggaggccgtgtggcgatcctgaccttccactccggcgaggacaggctggtgaagaaatcctttaaacgcctgaagaaggaaggcgtttacagtgagatcgcggatgaggtgatacggccgtcggcggaggagtgcttgaggaacggacgggcgcggtcgacgaagatgagatgggctgtgaaggcgtgaggaaggcagttgaattcgaatcagcagctaaagtttaaaagtatgttataatacgcgcaggggtatcaggggatagtcctgcgcttttattttgtaacggttcacagcccatggatttcgtctgccgcccggcccgctctgccggaggaggtgattcgtggactgcgaaccgttatgcatttttcaggaaaaagaggggagaagccgactgttcttgacagggaaagagccagaacctataatttctgtaggacaaaacgacgaggttatgggatatggaaagaatggatgcgctgctgtacgactgcgatatcagggagcccctgtttgactacctggaagagcggttcgggaaagcaaggatgtttgaggagaaaatcatcggaaaatcgagggctgacgtcttgatggtgacggagggcagaatcacggggctggagattaagagtgatgcggatacgtacgagcgtctgaagaggcagatccgtgactacgacaaatactgtgacgagaattacgtcgtgatcggcagatcgcacgcgaaacacgtagaagagcatattcccgcctattggggagtgctggtcgtgtctgtgaacggcagagagatcgtgattgaggaaatgcgccccgcgcagcagaatcctaaaatgaagcgggaattgcagcttgccatactgtggcgggcggagctccagaacattatcgaacagaatcatttgcctcattacaggcagaagagtaaacggtttgtgagggaaaagctgttggagaagctggagtggaaccggctgaagctggaggtctgtgaggaattatttgaacgggattatacgcttctggaggaagaggaggaatgaaagaggagaaatgagaacggagaaatgagaacggaaaatatttgaaaatgtagtccgggagattaggaagatggattgtgataatagaaatgaactgcttgtgaacatagataaactgcataccacagatttgggggtggtgcggattaagaagaatctgacattggatacggatgatgtggtggcgtggtgcagagcggtgattgaaaatgtaaacactggtataaccagaaagggaaagaactggtatgcggagaatgaagcctgtatcataacagtcaatgcgttcagctatacgattattacagctcataagcgcaggaaaatgttgtaatctacacgatattggtttggggtatttataggaaaaatggggatgaaaactggaaactcggaggaataaacggttagtcctgatttgatgttgtgttataaagcaaggatatcggatttattgggagaatctgaagcagtcatggtggaagaggcggcagcgatgccttgaggacagcggatttcgatgattgtatgaaagtcagatgatagttatcgtcaattgcatgtatgtgattggcggtattttttttgcggcaaagaagatttatttaaataaatgtattctaaaaaaataaatcacaaggtaccttgacaaatggacggcggaggtgtaagatgagattacaaggtacctaactaatcaaaacatacctaacaaattgaaacgtaacgaactaataaacaaacaaaacaggaggatttctatatggatgaaaataaaacaacatgcccatgctgtccaaatcaatgcgaggccggagcgctgcagtgcggaaaagggagggcgtacttccgtaatgaagacaatggcggaagcgagcgaagcaatcgaaacgagagtgagcataaccaccaccagggtgaggggcggcagaatcatggcggcaggagagaactgggggaacacagaagaggcagatccatggaagcccatggaaggaactgtgaaatgggagagcgccgtcacggcttagtaatagaagaaaagcttcagggccagctgcgcgcctgcggccacttccttcattataatatggggcagaaagtggggcaggccagaatcttatctgtgcttttagagcgtggaaccattacccagcgggagcttcaggatattctggaggtgcggtccggatcactgagcgagattttaaataaagtggaagcggacggattcattgagaggagccagagtgagaatgaccggcggcagatggaggtaaaactgacggaagcgggaacggaggcagcctccagactggaagaggaacgcggagatctgacgtccggacttttttcctgtttgagcggtgaggagaagaagacactggcggaactgctggataagctgttggacggatgggaaggcccggagcgtgaacgaggctgcaggggcaggggacacggccggcggatgcatggccgggaagctggccagacactgtaaaaccatagtaaatctgcacaatatacaggcgattgtgaatggatagtttttaacaaacttttcccggacggtaaaaaaacgctgacaatttattttccaaaatgttaaaataaacctataggaaagggaggttttaacatgagacgaattgtaagcgcatgtttactgcagaccatgagatttgatacgacgaaggaggctgatccggagcaggattttaccatcttttgcaaaaagctggaaaagagcagtgtcaaatatgtcattgaagagaagacaaaggaagcggacggctccctggtggtgaagatcaggaagcagtataactcctacagtacggacggatacctgcagtaacaaacgttgatgctttggaatcaatgagattccaaagcatctattttaatttcaggagggaaactatgttttcggtaaatgatcatgttgtatttggaaatcatggaatctgtgtgataaaagcgatcggtcctctggatctcagcattgcggaacggggacggctttattacacgctggaaccgctctatgcacagaaaaataccatttatacgccggtggataacgaaaaaagctccctgcgcagagcgattacaagggaagatgcgctggaactgattgacaggattccgcaggtggaaactgtttgggtcctggatgaaaaacggcgtgaggaaaaatacaaggaaatcatgaagcagaatgactgtatgggctggatgcagattatcaagaccctgtatttaaagaagcagaaacgtttggcagagggacggaagaatacagcgcgcgacgacttatatctcaagctggcggaagatttcttatacggcgaatttgctgcggctctcggagtggaaaaagatcaggtggaagagctgatcggccggaaagtaagggaaatggaatccgcttaaagaccaggtacgactgtatcagagaagagaggaggcggccgtaaattggatagtcctgaaaaacatgaagcagtaaatgcggagaaacacacagaacatctggaagaatgcacagtagaacacacagcagaactcagggaaatactcacggaagaacaggcagagtcgccagacgactgctttgcagaagctctggcagactgccggctggaagaggcggaatctttcgattttgaagacgaaggaccggagctgcctgcgtttagcgaggaggacgaatatctccatgaggactccgtccatatctatttgaaagaaataggaggcgtgcggcttctgagcccggaggaggagacggaactcgccctgaaggtagagcagggagatgacgacgcgagagaccgcatggtgcgcgccaatctccgtctggtggtcagcgttgccagacgatatgtgaagggcagcggtatgtccttcctggacctgattcaggaagggaacattggcctggtgaaggcggtggagaaattcgactgccacaggggctataagttcagcacctatgccatgtggtggattcgccagtccattaccagagcgattgccgaccaggcgcgcaccatccgtcttcccgtccatacgaaggaactgatggggcgcttaacgaaggcctccagacagttcttatcggaaaacggcaggaatccggagccgcgtgagcttgccgatatgctgggaattccggagaagaaggtggaaaatatccttcagctttatggggataccgtctctttggatgcgcccgtgggagaggagggagatggccaggtcatcgattttctgtcggacaagtctgcgccggaacagtatgagcaggtggaggcaggcattattcacgatcaggtggagaaagccctgggccatttaagcaagcgggagcaggaggttttaaagctgcgttttggttttgtggatgggcggatctggacgctggaggaagtggggaagaagtaccatgtgacgcgcgagcggatacgccagattgaagccagagccttgaggcggcttcgtgcaaaaccggacatccggaatcttagggggtatttggaagcgtagggtgagtaggccctgtctgaaaaaggggataaagaacatgaagctgatggaagatctattgacttaacgtttgtccggcggtaagatgaagataagtattgcgtgaatttccgtgatcaaaccgaagagggaggaattgcatgaacgtacttatcattaagggaagtcctcatgaaaaaggcaccacatcgctgctggcaaagaaattcgaggagggagcacgggcggctggccatgttgtccaggagattgacgcggcccatatggatattaaatcctgtctgggctgtaattactgcaggaagaataacggaatctgcgtccacaatgacgatatggcggacgcatacccgatgctctccgacgcagatgcgatcgtatttgtgactccgctctattactttggctttacctcgcagatcaagaaggtgattgaccgcttctacgccatgaactccgaactgagggcggaagccaaaatggcctatttgctcgcggcaggagccgacagagaggactgggccatggaaggaataagcgccacatttgatgtgatgtgccgctatcttcgctgggaaaatgcgggaagcgtcctggctctcggctgcggaagccgtgaggagataaaggaaagcgaatatttaagccaggcagaagtgcttggaaggtcagtttaacagaagaagccgctgtatcagcagataaaaatactgatacagcggcttcttctgttctgtgccggttgcagtgctccggtgtattacccttttgcgtcctccgggcggagattcgtgagcccggtaatgagctccacacaccggtccaggcccagctttccgctgtccagggagatggcgtaattttttgccatgccccatacctgcccggtgtagtatttgtaatagacttctctcttcttatccttttcctccagacgtttcgcaggacttttttccgtttccccgtaaaggcggacaatgcgttcggcccgtgtttcggctgcggcgtgaacgaagacattgaggcagtccgtccgttcctttaaaatatagtctgcacaccttccaacgatgacgcaggggcctttttccgccaggtccagaatgacatttctctggattacccaaaggaaatcgtcggccgacatcccgttcatggctccattcattcctctggcggcaaaggcgtatccgaagatgcttttcgagggagcatcctcgccctgtttctcgatataggattcatcaaagcccgtctccacggccactttcttgaccagatccttgtcgtagtaggggattcccagtttttcagccgccatttttcctatggtacgtccgccgctgccgaattcccggctgatggtgatgattcgattattcatgtgttctgacctccattcgctttaaacatttatattcgtgtgagacaagaataattgtaagaatcagagaaagcacatcggcaatgggggccgcccacagcattcccgtgacgccgaaggccatcgagagcaggatgacgcccggcaccaggaagacgacgtctctggacagggaaaggacagtcgccttcaccggttttccgatcgactgcaggaaaatactgctggccttctgtacgcagcagagcaggatgcctcccaggaaaatacggaagcacatattagcgtattcattatacagaccgctctcgctgccgaacaggctgacaatgacctgcggacagaattcgaagagcagtgtggcaatgatgccgatcaccgcattggcggcgatgatatggcgatacgtatcgaagacccgtttaaaattaccggccccgtaattatatccggcgataggctggccgccgaccgcgatacccacggaaaatgcgatgacgatgccaaagaccttcataacgatccctacaacggaaaggggaatatcggccccgtaaatggactggggccccttgagcccgatcatgttgttggacacactcatgacgatgacaatggcaatctgcgtgataaagctggagatgcccagctggccgatctgccccagcagccggccatccggaagaaaactggccttcgagaagcgaaaggatttcggcttccggaaatagaggatggtgacgaagcaggaaaccacctgaccaatgacggtggcgatggctgcgccccgcacccccatgtgaaatacgaagatggcgacagggtccagaatcaggttcagcacggcaccgattacggtggagaacatggaataagcgggggagccgtcagcccggatcgccgcattcatgccggaggcgaaaatatagaaggggattccgagcagaatgacctccatgtattctctggcatagggatagctggcctccgtcactccaaacaggcggagaatctgatccgtaaacagaaagccggtcacggacagcaggaggccgatgattacagtggccagaattccattgccgatgcatttgtggctggtttccttgtcgccgcttccgagggagaggcttaatttggctgcgcttccatccccaaccagcagggccagggccagagcagccacggtgaacggatagacgacattagttgccgcattgccgaggtaaccgacgctctgcccgataaagatctggtccacgatgttatagagggcgctgaccagcatggaaagtacgcagggaactgaaaatttcagcagcagcctgccgatgggttctgatgcaagataggcgtttgcatctcgttttgtctctgtcatagataatcactccttatgaataaaaactgcgcgcaatcaaagcggaagattcccgcttatagattacacgcagttattgctggatttacatctattctgattaaacacgcatggataaaacggaaatggtaagatttttccgctgtgaatcattataaccgatcggacaatgcggatgtaagaagaaaattcattttttagaaattttgtgaaaaatgcgcataataatttctttacgaaaggccccggaactgatccagaggatctatgataaagtaacactgccggagagtctgctttttatcagccattttaaggggctgtttggatttttggtgatggtgccgtgagagataagcagcccggctcccgcattgagcggcttttgcagtaaaacgtataaaattcctgaaaaacaagcttctatacatatccggcgggcaattggcgaaagctatttagacatatttcataaaaaagcaggtggaattccgttaaaaatcctctgtacaaactaatatattagtactaatatattagtatagtggaagctgtaaaccaatcttatttatcatcaggaggaaaatcatatgaatatgtcacttcgctggtatggaccaggctatgacaccgtaactctggaacagatccgtcagattccgggcgtgagaggcgtcatcacgacactctacggaacacagccgggagaggtctgggatagggaagaaatcagaagcttaaagaagaccgtcgaggatgcggggctttccattcttggaatcgaatcggtcaacgtccatgacgacatcaagacaggggcaaaggacagagaccgctgcattgacaactacatcacgacgctggaacgcctgggcgaggaagacatccatatggtgtgttataactttatgcctgtgtttgactggacccgttccgaactggccagaaagagggcggacggctccacggttctcgcttacaatcaggatatcatcgacaagattgacccggagcatatgagggaatccatcgaagccatgtcagccggttatgtcatgccgggatgggaaccggagcgtatgggcaggctggcagatttatttgcgatgtaccgggatgtcgatgaggagaagctgttctccaatctcgtttatttcctggaagccatcgggccggtctgcgagaaatacgacatccgcatgggaatccatccggacgatccggcgtggccgatatttggacttccgagaatcattacggataaggctcacattgaaaaattcttaaaggcagtcgataagccgtacaacggtctgacgctctgcaccggatccctgggctccaatcagaacaatgatattcctggcatcatcgaggcagcaaagggaagaatagcctttgcccatgtcaggaacttaaaatacaattccgaccgggacttcgaggaggccgcgcatctgtcttccgacggctccatggatatgtataaaattatgaagacgctttacgacaccggctttgacggctgtatacgtccggatcacggccgtgccatctggggcgaggatgcgatgcctggctacggcctgtacgaccgtgcattgggcgcgatgtatttacagggcttatgggaagcgatcaggaagaatgggtagccgggaagaccttatgtatgacgtgctcagaacggatatcctggatttaaagctgagacccggcctggttttcagcataaaagacgtctgtgatgcgtacgggacggggcgaaccccggtcagggaagcgctgatccggctttccaaggagggcctcatcacatttctgccgcagaagggaacgatggtatcgaagatcgatttccagagggccgacaatgaacgttttctgagaagctgtgtggaagaacaggtaatgctggaattcatggctttgaatgaccatgaccgggcttcggaggctgccgcggccttaaaggcgtctctggaccggcaggaaataatcgtgaaggacagggactgccgcggatttctggaggaggatatcgtgtttcactccgtattttaccaggcagtaaaccgggatacctgcgctcacatcatccatgcgaactcaggcgattaccgccgtatccggctgctttccctgacggagaccggaatcagcgacggagtggtgcggcagcacaaagagctgatggaggccgtcctggagcgtgacgaagaacggatgcaccggcagctggcccttcatttgaataaaatggtgaacgaggagcggttcctggtagagaaatacgcggagctgtttaccagcggcgaggcggaggaaaaacggaagaacgacggctttgccgaggattttctggtcagcactgcattgcgcgaggggtaaacaccccgccgcaggcaatggggtatttgaccctggtgtctcccggcagtacccgataaagcggggcaggctatcgccagatgctcatgcaggaatggtacttggctcgttattcgcgggaataaatgaaagaggtgtaaagatgaatttaacagatacaggattacaggaaagacaggcatgggagaaggcgggcattgagattccttcctatgaccgggcggcaatggtaaaaaagacaaaagaggcgccgggctgggttcatttcggcgcgggtaatatattccgcggcttcattgcgggtcttcaggatgcgcttctggaggaaggtcttgccgacacggggatcattgcggcggaaacctttgattttgacatcatggacaagatctatgagccgttcgacgatctggcccttttaattaccttaaaggcggacgggagcacggagaaaaaggtgatcgcctcgatcgcggaaggcgtgaaggcggattccgctgatgcacaggaatgggaacgcctgcgcaccatctttataagcccatctcttcagatggtatccttcaccatcacggaaaagggctatgcactgaagggggcggatgggacgtatttcccattcgttcagagcgatatcgacaatggaccggagcatccggccggcgccatggctgtcgtctgcgcccttttactggaacggtacagacagggcgccgcgccgctggccgttgtcagcatggacaactgctcacataacggagagaagcttcaaaattccattctcaccatggcggaggaatggaagaacaaaggctttgcggacgatggtttcctggaatatttaaagaacgaagaaaaaatcgcgttcccctggtccatgatcgataagattacaccaagaccaagcgtttccctggcggagcagctggaggccgacggagtcgacgccatgcagccggtgatcacgtctaagaggacgtatatcgcaccgtttgtcaatgcggaggggccgcagtatctggtgattgaggataagttcccggcaggaaggccggcgcttgaaaaagcgggagtctatatgacagacagagatacggtaaacagggtggagcgcatgaaggtaaccacctgcttaaatccgctgcacacggcgctggctgtatacggctgtattctcggctacacctcgatcgcggaggagatgaaggatcccgagctcagggcgctggtggagaaaatcggtttgacagaaggtatgccggtggtgaccgatccaaagattctttccccggaggcttttgtgaacgaagtcatctatgacaggcttccgaatccatttatcccggacgcgccgcagagaatcgcaagtgacacctcccagaaggtgggaatccggtacggcgagacgatcaaatcgtatgtggaacggtacggcgacgcgaagaagctgacctttattccgctggcgattgccggatggtgccgttatctgctggctgtagatgatgagctgaacccgtttgagctctcggctgatccgatggttccggaactgaaaggctggctgcagggcgttgaggcgggaaagccggagacgtatgcagggcagctgaagccgattctttccaatgagaatatttttggtgttaatttgtatgacgccgggattggcagcctggcagaagcgatgttcctggaggaaatcgccggagccggtgcggtgagagagacacttaggaaatatctgaattaaatattgaataaaatgaatggaaagagcggttccgaactcttgcaatatttacagcgtttcacacgatcttagaattaggaacagacttctatatcccccctggtctcgacagacccggggggatttttgtgcattagggtgtgtttgaaaattcattcctgtcatacggaatagcaacgatgacgctgttcttcaaataaggaatactgacaaaggaaatattggcttctgtgccgtagcacgccatgagtctgcgataaatattgttcagaccaaagtgatctctgccttccggctgttcctcggtcagacaggctgtggctttggggatatcaatccctttcccgttgtcggacacctcaatgattatgtgggtgtgagtctgatctaaggtgatggatattgtgatctgcggtgcaacaggccatgtctccagactcatgtttccaaagccgtgctttaagcagttctcagcaagcggctgaagaagtaccttcataattttgcagtttttcagatgcgaatcgatatgacaggtaaaatgaacgccctccctggaatgacggttcatgatctccatgtaggaggtcacgtgttctgcctccttttcggcagaaatgaaggtttgccccacacttaacgtgatccgcagatagcgtcccaggctttccagcatacttcccgccgtatcggagtgtccgtttaatatttgaaaatgaatacattccagtgtattatacagaaagtgcggattgatctgttccgacatcatctgaatctccgccctggcttttttctgttcctcttctttaatctgcagtaactggagctgaatcgtatcatacatctggttcaattgtattcccagcacgctgatctcatcagagcggggaaatacgacctttgtctggtaggaacggcggttgatttgagcaataatatctcccagcgttttaatatcccttgtcaggaaatgggacaggccgaaggccagcagggctgctgcggcagaacagaacagccataccataaaaaagaaagaccggaattcctgaatatcgccggtgagtgcggattttctgctgatatggactaccttaagatcacaaaaacggatagcagccgttgaaaccaccagctcgtcccggtctatggccagatgctctccgcggagattatccgtctgtgctaccaatgcttccagactggtcccaaaggcatcgggatacgtctcttcctgtatatccaggggaattccactggagtcggccagatacatgcagtaagtatagccgttggacatctggtcaaagtatgaccggatctgtcccgtatccatcaaaataatgacccgcgccttatatttgccttccgtatcgcggtatgcaaaggtgccggttcccctgctgtaggagaccggataggagatggggatagcgcctccctgccggaacagtaaattctgacgggttggaaatacggtaataagaggatattcccagatgttttctgtaaaaagcgtttcaaagctgccgccgaatccgagagaatagggactgaaaagaaagccattttctccgcagatcagaatgttgttgacctgggcatggttttggaagaaggaagccatctcatcggaagccgcctgataataaccggagtaaccgtcgaagctgttattggcaatatcggcaatcatatcgggaaacggctttcttaccagaagattgttcgtagcggcggagagggactgaaactgggaggaaagtacggcgccggcagtttccaccgactgttctgcttttttcagaacctccctggtgtttcgcttgtaaaaataggaataggacagctggctgatcagcagcagggctgccgtggtgatggcgatcatgccgatcagcagcttgtaccgaaattttagattagaaaaccagtttctcatagtcagcgccttccttctccggtatactgcttctgataatcggaaggcgtcaggccggtacgtgttttaaatgcgcggctgaaagaccggtaatcctcgtatccgagaaggattgccacatcgcctgctgtaatatcagggtgttttaactgttcctgggcgtagctgatttttaaatccagcagataatcacggaaatttaaagaggtcttatttttaaaatacgtgctgaagtagcttttgcttaagcccagataactgcagacctcctccgtatgcggattcttaagcagattggcatggaggtaggcgatggccttttcaatcagaggctcgttcttggtggcccggctgacggcgagttcgttggcaaaaccgtttaaaatctcacacatccagcttctgacctcttccagggaagagagattcgacagcgcggcataggagttgccggtaaagctgatcggggggccgcccagataatcagccagctggctttgaattgtaatgatgatataattgcacatactgtagagataagagggcggcggaagcggggcggtgataaggctgtcaaaataagaggtaaactgcagccggatgtccttcggatcatttcttaaaactgcctgaaggatatcatcgccgggcatgatgacaggcggcggaaggcagtttgtcacttccggttctatgacaagaccggcttccggatagatatgccatgtgatggcctgtcgggcattctggtacgaggcgggaatttcggacagtgatggtaccggttttccgatggcagccgccagattatcccctcgccaggaggccaggcagcggttcagcagctttgaaagagactcctgcgtgtgatgatgaaaaggcagattgacaacgagaatcagtccatccggcggatattcggagatgagaacgggactgtcagccagttcattctccaggattttctttaatgcaacgagactttgattcagctccacattctcatccggatcgaagcgggttcggaacgtctggatcagtaccacgcaggattgtgtgttccggatgagcagaccgtatttagaagaaatacttcccagctcttcctctgccagctcccctcttaacagctggggaatcaggttctgcctgtgaagcgatacttcggctttcctcaatttgtgaagtgttgacaattgatcggtatgaagatttcttttatccacaatagattctttcagcttacagatcagattggtcagttcctttatggagatcggtttcagaagataatcttcaatgccgtaccggatggcagttcttgcgtactcaaaatcatcgtaaccgcttaagataatgaaggagcactcaaactgttcctccctggcccggcggacaagctccagtccattcattccaggcatctgaatgtcggtgattacaatattcggttcataataacgtatcttgtcaagcgcctctgcaccgcttgcagctgtcccgatgacagtgacagaataatcttcccagggaatgatgctgcgaagtccggtccggatctcggcctcgtcatccacgatgagaagggtgatagctgatatcgaattcataggattctcctcaaaacaaggttaaaattttagagcaaggccattatagcattgtgaataatggaaagcaataaattggcgtgagatttgtacagttcgaaaaaaatgccgcatagacagtaaaaaatgccatgtgagttatggaaaatatgcagtaatatgtgagcacagacaaacaaaaacagtacaaaacaaacagattacaaagcaaaggaaagggagtaaaaactatgagaaaaggaaagaagatagcggcgctgagtctggcgggattaatggctgtttcagctcttacggcatgctcacagggggaaacgaaagagaatacagcagatcttacatctggagccttggcggcagaggggaccggggcaaatgaggcaggaagcagtgcggcttccggagaccgagttaagattactgtatggacagagaaccgccatgacctggattatatgaataagatagtcgaggagttcaataacacgaatgaccatattgagattgaatatgtggtacagacggaaaactacgtgaatttactgagtatggccgccaattccgggcagtcacccgatatatttactcaggtgaacatcacggattttaagaatttcgtggataacggaatcgtacagcccatcaatgattttataaccgatgaattcagaacgattaatgaagtagatgaccacttatacgaaggggccaatgtgatgggggatgagatctactgggttccatgcgggaagagaagcggttccagatttatttacaacaaggaaatatttgacgggctgggcctggaaatccccaaatctatcggcgagcttcctgaactggttaagaagatcacagaggcgggaaacggagagtactatggaatcatattccccggtatgagcggtccgttcgagcgctggctggaacactctgcggagatgagcggtgtcacaccttacgactataagacggggacctttgattttacaggctttaagccatggctggaagtgacccgccagatgtttgaggaaaacagtgtcttccccggatcggcatccatgaagattgatccggcccgtgtacagttttccgaggggcacgcggcaatccacgcaaatgcttcccaggaagcaaccgtgctgacggagcagtttccggcacagattgaatgggcggtagcagaccttcccacattaaacggcaggatcgaaggctgcgaatacgccaaccccaataccggctggctgatgagcgcgtttacggagcatccgcaggaggcatgggaggtgatcgaatactttggatcagaggaagttttaaagggatactttgagaacggctactctcttccgatttctcagtatatggatgaaaaaatcgataaatccaagatcggccgcatggcagactttaccggcgcagattatgaagcggtacttccggtagcaccgtcggtaacaccggagggagagaattaccgcgatgcgttgtggaatgcttgtctgcagggcggtccagacattgatgagacgattgataatttaaataagacgtataacgctgctctcgataaagaagtaaagatgggtaagacaaaacggctcgtgattaaggattacgatcctcttcatccgggagacggaaccatagagtatctggacaattaataaaaactcagtaaattgaaaggagccggctgctgcaaatagactgttgcagcagccggtttccatttggaaggagtaaaggttatgaatacgaaaaaatcattcggacagcggatgaaaaagagctggcaaaaaggtgacattaccatgtggattatgctgcttccgaccatcttttttattctggtcatgtccgtgtatccatttctctggctgatccggtacgtgttttatgattataacggattcaaggcatattttgtcggtctggacaattttaaacgggtgcttacagataagatatactggaacagcgtcctgcatacctttgaatacgcggttatgaagctgttgtttgtgattcccctgtccctggtgaccgccgttctgcttcagagaaaacggtttgggagcgggttgtttcagggaatatttttcctgcctacagtcatcagttctgcggtatacagcctgatctggtacttcatatttgccacctacaacggggtgctaaacggttatcttcaggcagcgggcgttattggagcccctgttgactggctcggaagctccaggaccgccatggcagcggtggtcatcgtggctatctggggggccttcggcaactatatgatactgttgatctcgggattgaccggaattcctgcggatgtctatgagagtgcccagatcgatggggcaaatggagtgcagaccttcttccgtatcacgcttcccatgctggggcccgtgctgaaggtggtcattatgctggccatcaccacggcatttaaggattaccagtccatcctggtactcactggcggcggccccaataaccgtacccacgtaatgttctcttacatatttgaaatggtattcgggacttccggcaaggcctctcagctccagatcggctatggttctgttttgagtatcatttcggccgtgatcgtgggcctcatcacgattgtttacttaaaattcagcaaaaagatggatgaaatatcatagaaggggggagcggtgatggcaagagaaaaaacaattcatgcagtggaatcaaaaaagacgaaaatgatcaatgcggtgattttcattctgttgttggttctggccgtcttgacggtctatccggtggtttatattattcttggatcttttaagaccaacagcgagcttgtaagcggcgggttaaatattcttcctgagaaattcgttcttgataactacattcaggcgtggaacatggggaatttttcccggtataccgtaaacagcctcgtattgagcttcggtgtcatgttcgtctctctggcagtcagcagtatggcgggatacgtattttcaaggcgggattttcgtttcaaaagcctgatctacaatgcgatggtcatgtttatgtttattaatgtgggcagcgcttccctgcgtccgctgtttgaactggcagttaagctgaatatgaataaatccatgctttccataatcctgatttcggcaggaggtggtcaggccacctatgtgttcctgatccatggttttatgaacagcgtgccgaaggaactggacgaagcggccaagatggacggctgcagcttctccggtatctacagccgggttattcttccgatattaaagccggcgctggccagcgttgcgctgctgtccttccgcggaggctggaatgaatatattctgcccctgatttttaccatgaccaatgaaaaactgcggcccttgacggtaggcgtcgtagctcttcagaatgcaggagacggcgcggcggcatggaacattctgtttgccggatcggccatagcggtgataccgatcattctggtatatctgtttgccagcagacagttcatgggcggtatgaccgccggagcggtgaagggataagctagtacagcgttgcataaattcctaagtaatagcaggcgctattactcagttatttatgcaatgctgtaccagggcgtgttagagaggaaaagaggagagaaaacatgaaatatcagttaaatgaatatggctttattacaaattatctggtgagcgggagaaaagagacggacttctccagcagtgcggcggataaaaatcagcttgcctgtgaaaaaatgatgcggtccgaggcagcggatcacgatccggttatgccggctggccccatcgttctgggggctttgagcgccctggggctgccatgggagtacgagtacacgtatggaagctggtttgtggaccggtcttccttctatccgctgctgaccagggtggagcttcacgctgctacgatactgaatgcccgggaggagatggaggcggaggtctggctctggagctacgctgcggtggatctctgggtgaatggggtgtttatggggggaattgagactcccgtatacaaacccattagccggaagatcatgaagctgcctttaaaaaagggggacaataccatctatatcaggctggtgaacttaggcgtccgggacacgagaaacctgtttggaatccagattccggggcaggaaagggaaatgctttcagtgacgctgccggatgcagagaaggccgcgctctgttcgcaagcagcagactggctgtcaggaatcatgatcagagaaaaaacgatggtatttcccgctccggcgccggaaggaagccgcctgatctacgatgccaggccggtggattttacggagtaccgtaaccgttattccgggataacgctgaggggagagacagagctggcgctggcaccggataagccctatctgaaggttgtggttaccgtatcaggccagaccctgtcaagaagctttgaacgacaggagctgctgaccattcaaaagggagaaaacgtagacccggaagagaacaaaaggcgcgtctttgagagaattgccggtgtgaaacagattccaaggggagattcggaaagcttttccatgtatccgattctggcacgttttgcctcaggcagagtggatccggaagatgagcaggagatatataagtcttttgaccagattgaaagcagacgggactgttcggactttcttacctgcgccatggtccgttttatgaagctgtatcccatgaatgaagccatggcggcacggtgcaaagaagtcatgataaactaccgttactggatggatgaggcgggaagtgacggtatgtgcttctggagtgagaatcattccctgatgttttttgtcagcgcttatgtggccggtgacatttatccggaggaattatttagccgttccggaaagaccggacgggagatgaaggagactgcgcggcagagaatccgtgactggatggttcagacagaaagagagggcttcgatgaattccacagcggcggctacacccctatcacctttgctgctattttaaatgtggttgatttttgcgacggggagttgtcggctcttgcgtggaaggcggcggaccggctattaaaggatctggcagtccagacctttcagggcgtctccatttcgcctatgggacgggtataccgggaggcgctgtacccttataagcaggatattcagtgtctgatcaatttaatagatccggaggcaccagaccagttcagtgagtggatcatcttcctggctaccagtaagtaccggctgccgaagggacttaaggagatgatgtacagcccggcgtctctcgtctatgaggagagcaatgccagaatctgtgtggaaaaacaggaggattacatgctgacctccgtggaatctccaagacgcgacggcagggtgcggaaatgggaaaatataagtgaacagccggatgccgataccggaagcttctcgtatgtgaaatcattaaacgaatgttttcacggaacaacccagtttgagcccggtgtatatggctatcagcagcacatgtggtatgccgctctcgatccggcagcggtggtgttcgtaaaccatccgggtggaagctgtgaaagctgtaccacaaggccggggtactggtttggcaacggaatcatgccggctttaaaacaggtaaaagaggttctctgtgcaatttaccggattccggaaacccatccgattccatttacccatgtatattggccgtcctccagattttcatatgaaataatagaagagacgtggctggccggcagcgccggcggcggatacgtggcactttggtgcagcgacccgtttacggcttatgatgacctgatgtttcactgcgaatacagggtaaaaagcagggatactgcttacgtctgtatctgcggaagccggaaagattatggaagtctggaagaatttctgctggcatgcaaagagaggaagcctgcttatgacagagagaagggaaggttaagggcagggaatgaagagataacttatagaaaatatgaaaatatgacccagtatatttaaaaacagaagatcagtattcctatgcctgccggttttggctgtacaggcaccgaaatactgatcttctttctgtattcttctttctggtattctttttctgcgattctagatggcaaccggaatcttatccgtaaacgtatggtattgataatcctccagccggaaatggtcttttgtaaactgatagaaatcctgtacttcccggtccataaggaacgtcggcgcctcataaggcactttttcaatcatttccttaacaatcggcacatgtctgtcgtaaatatgggcgtctgcgatgacatggaccagttctccggcctctaagccgctgacctgggcgaacatgtgaagcagaaccgcgtactgggtgacattccagttgtttgcggtcagcatgtcctgggagcgctggtttaaaatcccgttcagcacattcccggatacgttgaatgtcatgctgtaggcgcagggatagagattcatctcgtgaagatcctgatgattatacaggctggtaatgatccggcggcttagtgggttgtgcttcagatcatagagaacccggtctacctgatcgaactcgccctctttgtatttatgcttaattcccagctggtagccgtatgcctttccgatgcttccgttctcatcggcccaggagtcccagatgtggctgtttaagtcgtgaatgttgctggattttttctgccagatccaaagcagctcaccgattgcggatttaaacgcggtccggcggagcgtcaggatgggaaattcctttgacagatcgtagcggttgatgatgccgaatttctttatggtatgggcgggagcaccatcctcccagaccggacgcacctcgctgtccgtatcccatacgccgtttgataagatttctctgcaattctgtatgaataaagtatctgcgtaactcatgatattcctccatgatcctgtaagtaattcagtaaccggcggcagggggcgtatattcttataatccgcctgccgccggttcaattataacagataccgctcgattcgaacaggtatttcatgaaaataatcagagtcctgtttgcaacgtgtgagaaaatgattcattctctgttagtggttcctacgttgtaatcgtattcttgagtttccgcaaaataagaggccacagaacaggcgggcgtgcctgtttcaaaaagggctgagattcctcatattttggacatataatgaaagttgttgaatatggaacgggtcaaattgaagattgcggataaaactgcggaaacttaagaaatgtatatattgacttcattttgacaatatgttacaatgcaattactacatcgtgtagtaataacgccgaatctgtgatttcagccgaataatatacattaaggtaggtgattccattgaataatgaagtgaaataataaaagattaaatacctattacacatagatagagtaataatatagatacctaaaaaggtattggaaagaggtaatttattatgaaaaaattaaaaaaaatggttagcttaattcttactggtttaatgttgctcgggacatgctcaaatgctttggctgcaaccccggcaaccccggcaatccccgaaggtattacatatgatttgaattcatatgaccttacaaaacctttcacggagaaaaagacttttacagacagtaatggccaaactgttgaggttattaacaaatacacccccaaacctcaggcccgcggaagtgaaacaaaagatgctgtggagggtttttgggaatcatatatgagttacggcgcttttggtatgtcatttacttttgatttatcaaaaagctctaatggtggttggactatctcaaatgcaggagatttattagtatatgcatttgttgttaatataaagagttcttctgttactataggaagagcaacctcttctgcatcttcgcctgcgcgcgttacaggtagtgcaaaatgttcactttttgacgcatatggagtatcactttttaatggcactatgacgctaaaagttaccgtaagccattctggcgttgttacaactacatggtaatagtgaattaaaatgtagtttaggaagggaagttctatgcctaatattaatattatgattttattagtaattcttacatttgttactttattatctataattatatttataataaaaaacaaatttaaaaaataagaacactgtaaattcatttaatacaaggaaccataatcaggcgatgaaactgcctgcattatggttccttgtgccccaataatctttattataatacttattactttacagtgctccgtattgacattactacattcacgtagtaatatacgaagtagaaaagcaattgtaatattatttgaggggatattaaaaatgaaacttgaactcacagaaacagaaacagaaattttaaattatctttgggataatggggaatggacatccgcagcagaattttggatatattttaacgaaaatggccggcctagcaaacgccagactgtaaacacctttttaacacgtatgaccgataaaggccttcttgtcaaacacgacaaaaaatatatgtatgctttgagcagaaaagaatatgaacaggaactggctaaagaagttttaagtgaaatgtttgatggttccttaaaaaaattcctatcatcattaacaggaaatcagaagattacagaatgcgaggcagaagatctcaaaaagtatattgacgatttagcctaatggtggccatatgaatttaatcttttctatgttattatcgagcaatagcttattattattatttattgtcatcgaacactttatgggcgatgcatttagccagaagaacaaatatcttattttaaaatttgccctgttcttctctatcctcccattgggttctgtaaaaacattaatttttacggtgataaattactatttcccaaccgtaaatatgatggatttatcgataagtggaaagatacaaacctttgtcgttacacccgtaggattttctataaatacaacttatagaaataatttaataatattgttggtatggttttctatcagcgtaataatgttcattgtgtgcctgcggaagcaatacatttttagacagcgtgtcctaaatactatacagaagtctactgctcccgaaacgttaaatatgctaaaaaagcatatgcggcttctaagcataaacaagaacatacgaatatatgtaactaatatggagatctccccattcaccatgggacttatagatgatccgattatagtcatgcctaccatatccgatttatataaacaggaattaattattcaacatgaattatatcatattaaagggcatgatgcctttatcaaatttctccaagtagtagtggttagaattttttggttcaatccgctggtttatctattggattcctatttaaataggttttgtgaacttgcatgcgatgagtctgttaccagtacactaagtgggaatgatagaaaaaaatatgcttatctaattgttaatttagcgtctctcggagacagtcatatcaacccctatatatcgccattcagtactaacaaaaataccattaaagaaaggattaattatattcttatgaggaatagcaaaaaatcacaattaacaattttacttacagtcgggatggtttttattagcagcattccagcccttgcgtatcagagccctaaaacattggtttttgaaggacagcttcagaatgattacgtcccgatgaattcaaatcagtctgtgacttttaaagaattcaatacacttgttgaactgcagatggaatatgatactcaatttactgatattgatggtcatatttacaaagtatctccctctggcaatgatgctaaaataaattgtcagcatgacttggttgatggggtatacgaaaaacacacaaaaaataaagatggaagctgcgtaacaaaggcttacgatgctcagcgctgcagaaaatgtggaactattgttttgggttcctttatcagcgaaacaaaatatgcaaattgtccacactaaattaccttatttcaagcggaagtctatcagaagaaacagaatatttaaacaggtatagcttgatgcgtcagatcggctcctttataagcatttgaggtagcaggctatatttattgtcggatggcgcagaaatgcatggagggctaaacagaagggagggatagcaagcaaaaactccctgcctatggcggaagcgcttgcaggtattttgaccttttctgacaagctgatagacgaagcctataaaaggcagatcaaggaggaaatgcagatgacacagattggacagatgctgatcgatgagggcatggagaacggaatggaaaaaggaattcaggcattgattgaggataacagagaagatggtgtttcagatgaaagaatcatcgaaaagctgcagaaacgtttttccatggacagagggaaagcggaatcgtatttggagcgttttacacagaagtagaatggaccgatgatttacatgtaaaaccggggcttgagggacccggttttatttttgcttagacggacgccaattggaaaatgagatttacgaaccatcgaaaataatttgcaaaaaagaaatatttgtatataatgatgtttagaaacaggacaggaggatactacatgaaagcgattgttgcggttgacgaagcatgggggatcgggaaagacggaaaattattgacccatctccccgaagatatgaaatttttcagaacggttacaaaagggaaagtggtcgttatgggtagaaaaacgctgcagagctttccggatgcgaagccattgaaaaacaggattaacatcgttttgacatcggacgataccatgaacggcgagggactcatcgtctgccgcagtgtggatgatgccttaaagcagctgaaggagtatgacagcgacgatgtctatattattggcggtcagagcgtctatgagcagttccttccatattgtgataccgcgtatgtgaccaggatgaaacgggatttcggtgctgacacctggtttgtgaatctcgacagtcaggaaggctgggaagagacggagacaggggaagagaaagagtatgaggggctgcattttgctttctgtacttacaaaaacaggaattgcccgaatcgataaaatcagaccaggacggaggacaaaagaatgttaaactgcgagagaacaagcgtaatgaattttgaaaatgccatccggggcgcgagaaatcccatgaacagctgggggcgtatggacagtggctacgacgaagacggtaattttgtgctgggacccaatgatatgagcctggccagacggttaagaaatgcaggcagtgaccaccgcaaatacatccggcagattttcgtatccgtggatatcaccgcaccgctgtactggtggaaggagtacgatacctataaagtagccaccgtggcaaactctaccagcacgatgcacaagattcacagcaaaccattttccatagatgatttcagccacgaccacatgactccggagaccctggaattcatgaatcagatggtggagtatttagagaaggtgcggaaccgctatctggagacgaagagcaaggacgactggtacgatatgatccagctgctcccgtccagctacaaccagatgaggacgtgtaccatgaattatgaatccttaattaatatgtactttgcgagaagaaaccacaagcttgccgagtggcacaccttctgcgactggatcatgacacttccttatgcaaaggagctgatagcggcggaagaagacgaagaagcatgatctgcttcgcggaaaaacaggaaaagaggttatcatgaacatattagtaactgttgacaaaaactgggcgatcggaaatcagggccagctcctggtctccattcctgaggaccagcgccttttgcgggaggagactcaggggggaatcatcgtgatgggacgaaaaacctttgagacccttccgggaaagcagccgctgtacggccgaatcaacgtgattctgtcaaaagaccggaattaccaggtaaaaggcgcggtcgtctgccactctctggaagagactcttgattttttgaagcagtactcccaggcctccgtattcatcatcggcggcagcagtatctatgatcaattcctgccttactgtgacaccgtccacgcaacctttatcgattacgaatacagcgccgatacccattttcccgacttagacaagtccggggagtggagccttaccgctgagagtgatgagcatacctactttaatttgtgttacagtttccggatgtatcagaagaaatgagccaaaccaggccgcaggaacagcagtaagtttatcctttatttttaagaattcatattgtcaggttggaaattagatggtaagatgataagagtaccatttctcctgattgttggggaaggctatcaggaaaggcgtacaggtataattcaccaaaagaattaggaggatgaagatgtataagattttaaaagcagagaaattagctgacaagatctatctgatggacgtagaagcgcccaggattgctaaagcctgccagccgggagaatttgtaattgtcaggatggacgagaggggagagcgtattcctctcacaatctgtgactatgatagagaaaagggaaccgttaccatcgtgttccagatcgtcggagccagcacagagagaatggctggtttaaagacgggagattccttcatcgatgtcgtgggacctctgggtaatccgtcggagttcgttcatgacgacttggaagaagtgaaaaacagaaagtatttattcgtagccggcggcgttggaactgctccggtatatccacaggtaaaatggttaaaagaacacggcgtttccgttgatgtcattatgggttccaaaacaaaggatttactgattctggaagacgagatgcggacggtagccggtaatttgtacgtcaccacagacgatggttcctatgagagaaaaggcatggttacagaagtgattaaggatctggttgtaaaccagggcaagaagtacgatgtctgcgtagccatcggaccgatgatcatgatgaaattcacctgcctgatgacaaaggaactgggtattccgacaatcgtaagcttaaatccggtcatggtggatggaacaggcatgtgcggtgcctgccgtgtatccgtgggcggagaagtgaagttcgcctgcgtggatggacctgaatttgacggccatctcgtgaatttcgacgaggcgatgaagagacagcagatgtataagacggaagaaggccgtgcgctgttaagacttcatgagggtgcgacccatcatggcggatgcggccattgtggaggtgacgagtaatggatatgatgaagaaagtgcctgtcagagagcaggatccgaaggtcagagcgacaaatttcgaagaggtttgtcttggatataatgaagaagaggcgagagcggaagccagccgctgcttaaagtgcaagaatccgaagtgcgtgggcggatgtcccgtttccatcgacattccgggctttatcaaagaggttcaggaaggcaactacgaggaagccgcaaaggtaatcgcaaaatcctccgcgcttccggcggtctgcggccgtgtgtgcccgcaggagagccagtgtgaaggccagtgtatccgcggaattaagggcgagccgatctccatcggtaagctggagcgtttcgttgcagactggtccagagagaatggcttcgttccggcggctccggagaagaccaacggcaggaaggtcgctgtgatcggttccggcccctccggcgtgacatgtgcaggtgatctggcgaagatgggatacgaggtgacgatttttgaagccctccacgagccgggcggcgtactgacatacggtattccggaattccgtctcccgaaggaaggcgtcgtacagccggagatcgataacgtgagaaagttaggcgttaagatcgagacagacgtcatcatcggcaaatcggtgaccatcgacgagctgctggatgaagaaggcttcgaggccgtattcatcggttccggcgctggacttccgatgttcatgggaatccctggtgagaacgccaacggcgtattctcagctaatgagtatttaacgagaagcaatttaatgaaagcgttccgtgatgattacgatacgccgattgttgcaggtaagaaggtagcggttgtcggcggcggaaacgtggcgatggatgccgcgagaacggctcttcgtctcggcgcagacgtacatattgtatacagaagaagcgaggcagagcttccggccagagcggaggaggtacaccacgcgaaggaagagggaatcatctttaatcttctgacaaatccgattgagattctcaccgatggcaacggatgggtgaatggcatgaagtgcatcaagatggaactgggtgaaccggatgcttccggcagaagaagaccggttgccattgaaggttccgaatttgtcatcgaagtggacacggttatcatgtctctcggaacttcaccgaacccgctgatctccgccactaccaagggtctcgaaactaaccgcagaaaatgtatcgtagcggaagagtcaaacggtaagaccacaaaggaaggcgtatacgcaggcggcgacgccgttacgggtgctgccacagtaattctcgccatggaggcgggacgcgccggagcgagaggaatccacgaatacttatccggacagggtgaataaaaagtattacaacaggaagtgtagatagaagtatcataacaggatgcagaggggctgccagcaaggcagcccttcctgatgatatatcatttcgtttgaggtgtatatgagtaagaagatagatttgctgcatggccatatttttacgtctctgacgggactggccctgccgattatggcgacggcgctggtccagacggcatacagcctgacggatatggcgtggatcggcctggtggggtctcccgcagtggcggcagtgggcgcggccagcatgtatacatggctttcccagggagttgtggcgctggccaagatgggaggccaggtgaaggtggcccattctctcggcagcgggagaccggaggaggccgccaagtatgcggcgggagcgatccagatgggcgttctgtttgccctggtatttgccgctgttacagtatttggagcccgtccgctcatcggatttttcggcttgagtgacggcgccattattcacaatgcccaggtgtatttgaagattacctgcggcctgatcttgttttcctttttaaatgcgataattaccggaatactgacggcgatgggggacagcaaaacaccgtttatcgccaatgttatcgggcttatcatgaatatgatactcgatccggttttaatattcggcgtcggaccgtttcccgtaatgggtgtcgccggtgcggcggtggccacggtcacggcacagatgattgtaacgattgtatttcttgtggtagtgaaaaaggacagactggtgtttgataaggtccgtttcctggaacggatccccaaagattatttccgggtgatggtccgcatcggccttccggctgcggtccagaatctgatctataccagcatttccatggttctgaccagattcgtggcaggcttcggcgacgcggccgtggcggtgcagagagtgggaagccagatcgaatccatctcctggatgacggcggatgggttcgcggcggccatcaattcctttattggccagaactacggaggacgccagtaccgacgggtgaagaaaggctatatgacggccatcggcgtcatgttcgtatgggggcttttctgttcgggcgtgctgatcggatttccgaggcagatcttcggactgtttatccatgaggcagatattattcccatgggcatcagctatctcgtcgtcctcggtttctcacagatgttcatgtgtgtggagctgacgacggtcggcgcgctgtccggtctcgggaagacactgctctgttccgttataagtgtcgtgtttacctcggcaagaataccgctcgccatgattttaagcagcacacagctggcgcttgacggcatctggtgggcatttacgatttccagcgtgatcaagggaatcctgttctttatctgttttctgtatgtatccgggaagcttccggaggatggcgcgcaggcgtcatggtaagtttagaagggggagtttgcaaatgaagaaaccgatgacacaggaagaacgttttgtacagatgatcgaaacgccggtttccacactgattccgcggctggcggttccaacgattatcagcatgctggtgaccgccatctataatatggcggatacctttttcgtcagccagatcggaaccagcgcatccggcgcggtgggcgtcatgttctccgccatggccatgatacaggctatcggctttacgctgggaatggggagcgggaattacatctcgcgttcgctgggggacagaaacggcggggaagcggaaaaatcggcggcgaccgcatttttcacggccctgatcatcggtgccctgatctcggttttcgggctcatctgcctgcggccgctcgtatttcttttaggggctacggaaaccatcgctccatacgccatggactatggcaaatatattctgatcgcagccccctttatgatgtcttcctttgtcatgaacaatattctgcgcgcccagggaaatgccatgtattccatgatcggtattaccacgggcggtgtcctgaatatgattctcgatcctattctgatcttcggttttgatatggggattgcaggagcggccattgcgacgatgatgagtcagatgatcagcttcggaatcctgttttaccagtgtaatttcagagaaggaagcattcggatgaggctgtccaaatttacgcctaccgggaaaatgtacggagagattctgcacgcagggcttccctccttctgccgccagggactggccagcgtggcgacagtgatcctaaactttgcggcaggaccattcggcgattccgctattgcggctatgtcgattgtctccaggtttatgatgtttattaactcggcgctgatcggcttcggccagggcttccagccggtatgcggttttaatttcggggcgaagcggtacgaccgtgtgctggaggcgttctggttctgtgtaaaggtggcgattacgatgctgacctgtttcggcatcatcgcatttgtgatcagccgtccgatcattaccgcattccgccgggaagatctagaggtgatccggatcggtacgctggcgctgcggctgcagatcctgacgctgccgcttcaggcgtgggtgatcatggtgaacatgctgacccagtccatcggatacgggttccgcgcttcgctggtagccatgggacgccagggcctgttcctgattccctcgctcctcattctgccgaacatctgcggcattctgggcgtacagctggcccagccggtagccgatgtctttacctttgcgctggcgacctttatcgtggtgagagtgctggaggaattgaaaaccatgcgggaggggcagaaaatgagccaaaaggccgggaggccggactcccatgccggagcacagccgctttagaggccatgttctgcgtgattataaaaaaatcataaaaaatataaaaaagggttgaattttacctatggtttcggttaacataagagatagagtatttctacataaaaattccagatgaaaatagagcgaaggaccagcgatgaatataaaaatacagttaagaagcaatcattttcggaagtggctgaggagactcggctgcagcctgttaatcggaagtatgctatgtacacagacagttcccgcgtgggccacatccaaggcggaaaaagagaagaaagaggctcagcagaagctggatgacgccaagaagaaggcggaagcggcagaagccaacaagaacgccgccaacgcccaggtgtcaaagctgacctcggatttaacggcgcttcttaccgatattcagttcctcgagacggatatcaccaacaaggaagccgacattaagcaggcggaaatcgattatgaggctgctaaaaaagaagaagaaaagcagtatgctgctatgaaaaagcggattcagtatatgtatgagaagggcgatacggagtaccttgatatctttcttcaggtaaagagtatggcggacctgttaaacaaagcggagtatgtggagagtatctattcctatgaccggaagatgctggatacgtatcaggagacaaagcagcaggtggctgacaacaaggcgcagctggagaatgacaaggccgagatggaggtaatggagctggagcttcagggccagaaatcccagttggagacgacgattgccaaaaagaagaaggaagtcagcaattttgactcccagttagcccaggcaaagaatgacgcggcggcctatgccaagaccgtagagaagaagaaccaggagattcagaaggcaaaagaggaagaggccagaaagaagagggaggccgaggaagcaagaaagaaagcggaagcggaagcagcaaagaaaaagagttcggctacgactacttcgaagaagacatcggccaacgacaaatacaccggcccggctgcggtaaagagcagcggcggatcggcacagggccgcgcggtggcggattatggccttcagtttgtgggtaatccctacgtttacggagggacaagcttaacgaacggagccgactgttccggtttcgtgcagcaggtatacaagcatttcggctactcactgccgagaagctcttcggagcagcgttccgcgggacgtgaagtctcttattcggaggcgcagccaggtgatttaatctgctacgccggccatgtcgcgatctatatcggaaacggacagattgttcacgccagcacgcctacgactggtatcaaggtaggtacggctacatacaggacgattttatcggtcagaagaatcgtataaggtgagattataaaaattatgaaacagcagaatgactggtacacggggatcaaccattacgacaactatgtggagaaggagatcgggatcgagcgcagaatcatcgacgggcccaccgatccgtatctccacgagcgtgtggagatattctatgtgttgtccggaaagggcgccatatcggtaaacggatatgcctacgacgcggtgccgggcagtctgttctgcatgtattcccaccacttccaccatgtggaagcggtggaggaaaagctcgatgtggcggtgatccggttccacatcgggctttttatgtatatgagctgggagaagcacccgaagcacgccaatgccaggctggtgtacgatacgaagcccatggtgagactttccggggaagagaaggaagaggtggaggcgctggtgcgcagccttcttcgtgaggcaaaggaagcgcgatttgagcgtcttaacatgatcgagtacaagacgctcgagctgcacgcctattactgccggtatgcctatgaggaaatcggtaaggcgtcccggaaggaacggacggtatggagcatcatcgagaaagtgattctggcaacgggagaggatatcacgctggaggacatgactgaggaggggataagccctgagacgatgaaccggaggatcaaggaagcctgcggattcacatttttccagctcaagcagtttggaaaggtgatcaatgcctgcgcgctgctgcattttccggaattgtccatggagtatatcggcgatcagctgaatttctcttctgccgcggcattttacaaggtgttcaaacagtactgcggggtgactccgcgggagtatcagacggagtatatcggaaccatggttccgggaagcggtgccggttcggcaatgcagtttcttcagtatatccatatccatttttccgaggatatacggctggaggatttatgtgagaagttctgtatgaagccgtatacggtgaagcagatctttaaacaggtgtttggaaatccctttgaagagctgctggcccaggtccgcatctcctatgcctgctcatttctgcggacaggggacaggacggttctggaaatcgcctctctgtgcggctttaactcacaatctacctttcagcggcattttaaacggtggatgaaccagacgccggaggagtaccgggaagtgatgagagaaaagcctgacaaaaaatgataataaaacttcataatgtgaatataaggagaagcccttctttgctataatgaaagtatcatgttcaatatgcgaaggaggttttttctatgtatgacagattattttctccgattcaaatcaggggtctggagctgaaaaacagggtggtcctgcctgcaatgggaacccgtatggcgggggaaaagggggagatcactccgaggcttgccgcctatcacgcggccagagcggccggcggctgcggcttaaacatcgtggaggtggccgcggtacatacacccagcgctcccgcacactttgtatccatcagtgacgacagcctgatcggagggcataagaagctgacggatgccatccaccagaacggcggaaaggcggcgattcagctgtggcagggctctatcgccacgacgtttgaccccagggcagaaatgctggtggttaatgatatggagtttgcgggtaagaagcttaaggctattacaacagacaggatacaggagattgtggagtgttacggaaaggccgcggcgcgctgtgtcgaggctggatacgactgtctggaattccactgcgcgcacaattatctgccccattccttcttaagcggaggcttaaatcacaggacggatgagtacggaggaagctttgagaaccggtcgagattcccgcttgaatgtatacgggcgattcggaacgccataccggaggaaatgccgctgttcatgcgtattgatgctcacgatgattatctgccgggtgggcttactatcgaagaaatcatcgaattctgccgcatagccggggaaaatggagtggatgtactggatgtatccaggggaaatatcatcacggccggatccgtttatgaggttccgcccatcgatattccgagaggctttaatgtggagaacgccgcacggatcagaagagagacgaagatggcgacgatcgccgtgggaaggatcaacaccgcggagcaggcggaagccatcctggaagaggataaggccgatatggtcgtcatgggaagagcccagctggctgatccggagttctgcaataaggcgagggagggcaggacagaggacatcatccactgtgtcggctgcaaccagggctgctacgacggattctgcgatttaaggaacagaccgtttatcacatgtctgagaaatccgtgtctgggtcacgaggaggagtggaagcttacaaaggcggagactccgaaacgggtctatatcgcaggcggcggaatggccggcctggaggcggccagggtgctgctcatgaggggccatcatccggtgatctttgaggcgggagaccgtctgggcggccagtttatcacggcgggccaggctccgggcaaggaagagatgaaacaggcagccatttcctttggacggctggtggagcggtcgggtgcggaggtgcgcttccatacgccgcttacaccggagattatcacggaggagaaaccggacgcggtgatcgcggccgtaggctccgcgccgattgagctgaagcttccgggaagcgggaagaaaatggtctgtcaggcccacgccgtgctggagcatgaagtggagccggagggcagcgtctgtgtgatcggaggcgggctggtcggtctcgaggccgcggatgcgctggcggcggccgggcatccggtgaaggtgctggaaatgaaggatacggcgggagaagatctgggaatgctccggaaaatcgccgtgatgcagaagctcggcggtgagtcggtcgggatcatcacaagtgcccgatgtctcgaaatcaatgagaccggtgtggtggttgagacaccggaagggaaggagaccgtggcctgtgacagcgtggttctggctgtggggtctgcttcgagagacagcagtgcgctgaaagaagccagtgagaaggctggggcggatttctttgttatcggtgatgcgaagcgggcaaggcgtgcgattgatgcgattgcggaaggatttgacactgcaaggcaggtatagaaggctgctgaagagggagcctgtatgccggtttcgcatagagctttgcacggaaaagaggaggaattatcgatgaaatccagattattagaagcgttaaagatcggttccatgaccgtaaaaaacggcgttttcatggcgcccatgtccctgggatacgagagcccggacggaacggtcaatgagaccatgcaggaatactggctggcaagggcgagaggcggcgtgggctgtatcatcaccgatgcgctctcggtagatcccgatgtgccgtatctgggcaacacgctgtgtttcagaaatgaagagagtattgcgtcctaccgccgtttcacggacaaaatccatgagtgcggtgccagggtgatcccgcagatcacccacccgggaccggagagtgtcagcgcgttccgcggcattccgcccatggccagcagcgtgtacttaaattctatggctcagaagaccagggctgtcacactggaggaaattccagggatcatacagaaatacgcaaaaggcgcatacgatgccaagcgcgccggctttgacggaatcgagctgcactgcgcccacgcgtatatgctgctgggatcatttttatcacctatgaggaacaaacggacggaccgttacggcggcagtctcgacaaccgggcacgcctgctgtgtgaagtcctggatgcgattcgggagtcctgcggccccgatttcccgattattcttcgtatgtcgggaagtgaacgggacgaacagggcaatacgctggaagatatgaagtacctcgttccgatcctggaacgtcacggcgtggatgcatttgaaatcagcggcggtacccagtatgagcgatgcaataagattatcccgtgccacggggaggtgcagggcgtcaacgttccggaggcggaagcgctgaagcaggcggcggctgtgccggtacttgtggtcgggaaaataggcgagccgcggtatgcggaatatctggtcgattcgggcaaggtggatggcgtcgtgctgggccgcgccctgattgcggatcccgacttcgtaaaaaagatggaagccggagattacgacggaatcgcaccgtgcgcggcctgcgccatcggatgtgtgggagaacagacgaaacgccatccggcctcctgcgtgatcaatccggcggcaggcagggagaaagagctggagcttacgaaaacggaaaggccggaacgtgtggtgatcgtgggcggcggaatcggcggcatggcctgtgccagggcctgtgcggtgcgcggccacaaagtcgttctcctggagcgggaaaatgaactgggaggccagatgcggcttgcctgtattccgccccataagcaggaactgagcaaatggattgtctatctggagcatgaactggaacggctgtctgtagacgtacggcggaacacggccgcggacagggacgttattgaccgtctttctcctgatacgctggttatcgctaccggagcgggagagatgctcccgccggtaccgggaatcgatccggagcaggcgataaccgcatggaaggtattgagaggagagacagcaatcccaggcggaaatgtcctggtagtcggcggcggtatggttggctgtgaggtctgtgagtacctgatgcatcagaagcgcggattctgtcatattaccatgatcgagatggcagatgagatcggcgcgggaatggtagtgaacaacaaagtgccggccatgatacggctgagccggccggagattaccatgatgacaggcacaaagctggtatccgtaaacggcggagaggtgacagtggaaaggcgcggcacacaggaagttttaagcggctttacccatatcatctatgcctgcggggcacgcccggtcagaggtctttatgaggaactgaaagaggcttatccggaggcggttctgatcggagacgcgcagcagcctgcacaggcgctggaagcggtgaggcaggcggtggagactgcggtgcggatcggttaatccaggaaaaaacattggattatggctgtccctgatgatataatggaaatataagaaatacatgaaggaggacacgctgatgaaacaatggctggatactgcggacgaatatataaagtcctggaaaatccgtgatgtggcgttgttaaagctctgcgtctgtgctgccgggtttctgtttggaatgggaatcccaaaacggcaccggaacaaagcgtcaatcgctgcaagtattattttctctgtgacctatgtgctggtgatgctcccatttttaaagctgctggacagaaacttgaaagagggagcggcttgaatgttggcctgaatgtgagcctgaacatgggcctgaacatgggcctgactgtgggccttaacgtgaaccagaatgtgggcctgaaggtggacctgactggagatgcggaagcttcgaaggaaatgctgcaggaagaaaggggagctgtcatacctgtgatttaccatcactggcggggcagttccccttttctcctgttttcgtaaccggcaaaacacggatcatcgattaagaaggtaaatagacagattcagatatgcggcgaacagacaccataacaggtatggaatctgtaagcaggctgccagaggggagattttataaaactggtaaatcatcacggctataagcaggatcagtgcaataagccagataaatgacagcagatattgggagagaccaaaaaacaggatgctccatccaaaattgaaaagaagctgtaatgcatagtatttaagcgcttttcctgtgtttggatcccccgagacatagatcatgtaggaggagatacccattaacaggtacagaattgtccatacaaccggaaacagaaaggccggcggtgataagggcggcctgatcaatgtctggtaggccatcgtattaccgctgataagcgcggaaatagagccgacagccaaagggatcatgattgaaatgagcagagcgctgatatttttcgatttcatagatgtacctggagactcgtgtcttcagacatgagaggaaaggcgcccctcagcgtctcttacagagtctctctttcctttcttttattgaatctttagaacgtgtaattccaatgctgtaagtgcggataacgaagcaatgatgaccggatcggtgcgatgaatttgtaccttgccgctccgaagagcatcccggcgtaacgattcaattccactgggatcgaaagcgaattcttctctggttagcagaggtctgtcaggcaaagccgaagcagaagggctgcagtcaatcagcctatagtagccaatgttagaggtaggagacagaggaatcccctgttgtttttactacggttgttgagctacaagcctgtgtctttagacttgggtaattgacagatgctcctttgacaggtggttagtaattatatgcgtgagagggaaggaaaaatgataaatcaggagatttcccaacccccttgattttacagggaaatccaaaaaatgcttgcgaaattcgacattctgtgagagaatatagctaagtatgatgtgatatatttaacaaagtacttttcacaattattacttattcgaaaggagttttaacatgatttattcacaggaagtagaagagatgtgcacagtggcacagggcgttcatcacggcgctgctccaatcccagaagaagcaaaatgggtaaaatctaaagaagttaaagatatctccggtttaacacatggcgttggctggtgtgctcctcagcagggtgcatgtaagctgactttaaatgtcaaagaaggcatcattcaggaagcactggtagagaccatcggatgttccggtatgactcactccgctgccatggcagcagagattctgccaggtttaaccgttttagaagcattgaacacagaccttgtttgtgacgcaatcaatacagcaatgagagaattattcttacagatcgcatacggcagaacccagagtgcgttctcagaggatggacttcctgtcggtgcgggactggaagacttaggaaagggacttcgttctcaggttggtaccatgtacggaaccttaaagaaaggtcctcgttaccttgaaatggctgaaggttatgtaaccggtattgcactggatgctgacgatcagatcatcggctatcagttcgtaagccttggaaagatgacagatttcatcaagaagggcgacgatccgaatactgcatgggagaaagcaaaaggacagtacggccgtgttgctgacgctgttaagatcatcgacccaagacatgaataatgggacaggacgataagtctacatagaaatatcggatttccatttgcagaatttgacatagcctaataacaaggaggacaagataatggctttatttgaatcatatgagagaagaattgacaaaatcaattccgttttaaacagctatggcatcgcttcgatcgaagaagctgagaagatcactaaagatgctggtttagatgtatacaagcaggtagaggcaattcagccgatctgttttgagaatgcaaaatgggcttacacggtaggcgcagccattgcaattaaaaagggctgcaagaaagctgctgacgcggctgcagctatcggcgaaggccttcagtctttctgtatcccgggttccgttgctgatcagcgtaaagttggtttaggccatggtaacttaggaaagatgttactggaagagaccacagactgtttctgcttcctggcaggtcatgagtccttcgcagcagcagaaggcgcaatcggtatcgcagagaaggcaaacaaggttcgtgagaaaccattaagagttatcttaaacggtttaggaaaagatgccgctcaggttatttccagaatcaacggctttacttacgtagagaccgagatggattactacaaaggcgaagtaaaagaactgtggagaaagtcctattctgaaggcttaagagcaaaggttaactgctacggctccaacgacgtaacagaaggcgttgcaatcatgtggaaggaaggcgttgacgtttccatcactggtaactccaccaacccaaccagattccagcatccggttgcaggtacttacaagaaagaatgtaatgagaagggcaaaaagtacttctctgttgcttccggcggtggtacaggacgtacacttcacccggacaacatggcagcaggtcctgcttcctacggtatgacagatactatgggacgtatgcactctgacgcacagttcgcaggttcttcctctgttccggctcacgttgagatgatgggtctgatcggtgcaggaaataacccgatggttggtatgactgttgctgttgctgtttcgattgaggaagctgcgaaggctgggaaattttaataaaatgcttacggaataaggctttttaaagatttaggaaatgtttggtggttggattaaaaaattgataattactaaactattgacattttctattttttggcgtaacatgatgttagcagagaaaagcggttgtgtccactggacgcaaagcgaaaccccaaggagttgcacctccttggggtttcttttcccttttgaagaggaataacttaggcagactgttggttatttatccccgtccaaccatttacaaatatagtagcaaactatacctgccacaacagagataagaaaagcggttatgtattgcactggtcgcacctccttcctgctggaaagagtcaacagcaattttattatatcgctttgatagaaggctgtctattgctttatatactaaaatccacaaagtgttctgagcagtaatcagaacggcagagtagcacactcatagcgcacaaacacccctaaaacccttgtaaatccagccttcacagtttctattgagaagaggcataggctggggaattctaattttatagagtataaaaaaataaaaagtgccgtaaccatgagggggtgcggcgcttttttttataacggatcagtgaaaaagcaataaaacagtatgaaaatgtatggaaatttgccagtaactaatacgtaacgaatacgtaacttaccggtaactaacagtggtaactaacaaacagactgcccaaaagccgccttttatatggagtgtaggcggatccgacaaatgcagctgcaccgtagttattttattttcactatttcaaccattaattatttttcatatcgggatgtgtgtaacgtttatcggattacatctacaatctcgtgctccgtaagttatttacggaccagaacgtctatgtgtgcttccattgcccggggagagaaggtatgcgaaggtatgccgtggcaccgaagaaaagcatgagtgaggcaggaagggtactgaacaattcaaattcaatatcattacgaaatgacagcaactgtccgccaaatattttttatcatagtataaacctttctgagaaacaaaaaaaccttcctgatattcagaaaggttcagactgtagacaactagcctcctaataggaggcggttgtctttttttctttaactcaggttttcgatgtagtataatagtgctatacgaaagtgaggttttttcttatgatggggaaaaaagattattcagaacgttctcaggtgcagattgcaagcctggatgacctcgtcccttccggtcatctggttcgcaagctggaagaagccattgatttaagctttatttatgacgaggtcaaagatctctacaaaccttatggcagggaaagcattgatccggttgtattaatgaaaatcgtgatcctccaatacgtgtttggcatcccttctatgcgcaaaaccatcaaagagattgaagtgaatcttgcttaccgctggtatctgggatacggcctgtatgaggatatccctcatttctctacctttggaaagaactataccagacgatttaaggatacggatctttttcaaaagatattctcccggattctaatggaggtggatgcctgtggtttcctggatacggaaagcctttttatcgatggcacccacatcaaagccagtgcaaaccctcataaataccagaatgaaaccatgaaaaaagaagcccggtgttacgaaaaggagctgctggaggaaatagagaaggacaggctggagcatggaaaaaagccattgaaagaaaaagagtccacgccacagaccataaacaaaaaggtcagcgctaccgatcctgacagtggctggttccataaaggggaacacaagcaggtgttcgcttatgcagccaatacctgttgtgacaaaaataattatgtcatagattttgaagtgacagcggggaatgtccacgacagtgtatccttctgggaactgtaccggagagtaagcagacgggtaaaatatcccaaatactatgtaatggatgcaggctataagataccggcaatcgcaagaaggctaatcgaggatggaaaggttccggttatgccctataaacgcccaatgacaaagaaagggtattttcgaaaaagcgattatgtatatgatgaatactttgactgttatttatgcccaaataaccagatactaaaatacagcacaacaaaccgtgatggataccgagaatacaaaagcgaaggaaaaaagtgtaaggattgtccgtaccaaaaccaatgtacaggaagcaaagaccatgtaaaggtggtaagccgccatgtatgggaggggtacatggaagaggtggaggagatccgtcatcagacagggatgaaagaaatctatcagaaacggaaagaaaccattgaacgggtctttgcagacggaaaagaaaaacatggaatgagatatacacagtacagaggattggcaaaagtgacaatggagctgacccttttatttgcatgtatgaatctaaagaaactggcaatctggaaatggagaaagggtgggctaaggaaaccctgttcttttgtctggatattcgaaccaatatatttatatataaaattcaaaatggttcctggtgcgatgcacccggaaccattttgtctacagtctgaaccttcctgatattcagaaaggttttcatgacctatccgggaatcgaacccgggtttccgccgtgagagggcggcgtcttagccgcttgaccaataggccgtatctgtcgtttccgacaacttccttataataccataggaaattggatttgtccagataaatttcaaaaaaatatgaaaaaaattttagactgtaaaaaacaccccataaattaggttgagccggcaaggtgacattacgtcaaccccgccgacttagtggaaacatatgtaggaagcgctctgactgcttaattcgatttcctatgtttataatattatcatactggaaaaatgtaacagaaatttggccgcaacgtaaaaagattatgaaatttattaagggtttctaacgaattatgaagtttgtatctttttggcataaaacagaggggagtatcgtcaattttataagaaaatttgaagtttataagaaaatttgaaaaaagtattgactatcacgcatggtgatagtgtaaagtgagagtcagagatgaggtccccggttccttccaacgccggcaggaggggcaggagaaccgaaccgggcggtaaaggaaggtgagaattatgatgactgttaaacaggtttccacattgacgggtgtcagtgttcggacgctccagttttatgacgagatcggcctgtttcagccgacggaaatgacggaagccggatacaggctgtatgatgaacatgcattggaagtactgcagcagatcctgttttttaaggaactggactttacgctgaaggaaatcaaagcgattatggaaaacccgcaatttaataaagcagccgcattcgaaaagcagagggagctgattcagctgaaacgcgacagattgaatggtatgctggagttactcgataaattaattcatggagaaatgtgtatggactttaaagagtttgatatgagcgaatattttcaggctttaagtgagtttaaagcaacacatacggatgagattataaaacagcttggaagtatggagcagtttgacgaaatgctaagcgcgctgcagtcgcatgaagatgagattgccagccaggcagtcaggcagtatggcagcattgagaattatacaaaggcaatgaaggaaggttttcagaaatatttgtctgaaggaccggctgtttcagagacagaagtgactgggattatggagcaaacggagctgttgacgaaacgccttacggccgacctaagcagagataccgcatctccggaagtacagaaggcggtaagcaatttaattgctttttgcgaagaaaccaataaaggaattgatatgggagagaattactggtcttttacggcggaatcctatcaatccaatcccatatatatcgaggtgaacgaccggaaatacggggtgggagcctcaaaatttatcggaaatgcaattaaagagtatttagacagaagatagatcatgtgaatgttaaaatagaataaacgttatttcaaatgctgcctttggaggagttcgtctctgcctggggtggcatttgttctgtatttacatatacggagcagcaactttccgtacaagataggaaaattattcgtttcatgttataatttttccatagatacagacggattttatgaggagagagggaatttaatggagacaattatctgcggacattgcggtgcaccggtgttttacgacgacgggctggggtacggagtttgtgaatactgtggttctatcataaaagacagggaagacgcgggcgaaaaccggacgaatctggacagggaagtcagctatattatggaagtgaagccgtatgcatgggaatacaaactgctttttgcagttctggactctggcctgcagaaggccggcagcctcaaacaggaaatgttccgtcctctgctcctcaccgatgaggccgcaaaagaggagatcctgcggtatgtgaagtggatcactggcaagctggagaagcttcaggagtacacagaaccgctccaccgcatttttaaggttgaattaccggaggcaatgggaccgcccggacagcctggcgatgaaacaaagctggtaaataccgcaaatcgtatcgggagcgtttatacaggccttatttactggggattggaattccagaccgacgcaacacccaataatttgaaggggttagcgttggaggcgaggggcatggccggatcaattctggagaatatcgaacacttttgctaccagggcaggaatcattttgcaggtcttcagcctggcatgaaggtgccgcaggataccagtcttgtcctgcgggaactgaagatggagcaatttatgggtgagcttaagaaactgggcgttctgtagcagtgagccaatcagatggatagatagaaaaatggaaagataaagtaatagaaagataaagtaatagaaagatggagaaataaattgatagagtaatagaggaaagaggagaaacagcatgattgatttaaagattctggaagaactgtccaatgcgttcggtcccagcggctttgaggaagacgtggtcagagtgataaaaaaatattgtagtggaatggcctttcgaaatgatgcgatgcataatgtatacacagagctgaagccaacggctcttacggccgggactggggacaacaatgagattcatgagaagcctgcattttcatccgacagacgtccggtgctgatgctggatgcccatctcgatgaatgcggattcatgattcagtctattatggaaaatggtcttatgagcatcgtaacactcggcggttttcaccttaccagccttccggcccactcggttattgtgagaacggcagatggaaaaatgcacagaggtattaccacgtcgaaaccggttcattttctgacaccggagcagaaggcggacaacagcctgaggatcgaagatatcctgattgatgtgggcgcgtgcagccgggaagaggtgcttgctgtgtacggaatccgtccgggcgaccccgttgttccggatgtggcgtatgaatatcatgaggaaaacggcatctgctttggaaaggcatttgataaccgcctgggatgcttctgtatcatagaaactatgaaggctctgatggaggaggaagaccgcctggcggccagagccgtgggtgcgtttgcggcccaggaagaggtgggaaccaggggggctgtggtgactgctcagcaggtgaggcctgatctggctatcgtgtttgagggctcacctgccgatgatccctatttccaggcgggaattgcgcagggagtgatgagaggcggtgtacaaatccgccatctggataacagctacgtatcgaacccggcgtttatccggtacgcgcatgagatcggagaaaaattaggaattccctgtcaggatgctgttcggagaggcggcagcacaaacgcagggaagatcagtctgaccggtcaggcggttccggttctggtgctgggaattccttcccgctacgtgcacagccattataatttctgtgcgaaatcagatattgaggcggccgtatccatggcagtggaagtaatccgcggcctgaatgtggataatatgaagcggattttcagacaggacgtgatttgatagtatggtgccatatgcgtacctaatcgggaaaatgtacgctatgggcggagaaaagcgtgtaaaagattggattttgtgtcaaagaaacgggattttgaggagtgggagtcgtttatttttcacagctttttctgaggacgcgagaaaatacttgtcaaggcttttccgatagaatataatatcatggaaagagctgttgcagaaatcggttaagatgcatgcaacagcctttcatcttcatttgcaatttttgtttttattgcaggaatgcgggaatgctaaagagaaagcggcttatgtccggtttttttcatttccggcattcgtgataccgtacatgattattataggaggaatatccgtggaaagagaaatgattattgttctggatttcggtggtcagtacaaccagctgattgccagacgagtcagagaatgcaatgtttactgtgaggttcatccatacacactgggactggataagatcagggaaatgaatccgaagggaatcattttcaccggaggccctaatagtgtatacaaggaggagtccccgcattgtgaaaaagaaatctttgagatgggaattccgatccttggaatctgttatggttcccagttgatggctcatatgctgggcggaagcgttgcgacggctccagtcagcgaatatggcaagacggaagtggatacagaagcggacagccggatcctcgattccgtgagcccgaaaacggtctgctggatgagccatacagattatatagaaaaagccccggaaggcttcaaggttaccgctcacacaccagtgtgcccggtggcaggcatggaatgtgaggagcgcggcctctatgcggttcagttccatccggaggttatgcacacacaggaaggcatgaagatgctgtccaatttcgtatacaatgtctgtaaatgttccggagactggaaaatggattccttcgttgaatcttccatacagtctatccgcgaaaaagtcggcagcggcaaggtgctctgtgctctgtccggcggagtggattcttccgtagcagccgttatgctggcgaaagcagttggaaaacagctgacctgtgtatttgttgaccacggtcttctgcgcaaggatgaaggcgacgaggtggaggctgtctttggccccaatggtccttatgatttgaattttatccgcgtcaacgcccaggaacgtttctatgagaaactgaaaggggcggaggagccggagaagaagagaaagattataggagaagagtttatccgtgtatttgaagatgaagcaaagaagatcggcacggtggattatttcgtacagggaaccatttacccggatgtgattgagtcaggacttggaaagtcagccgtgatcaagtctcaccacaacgtgggcggacttccggagcatgtggattttaaggagatcatcgagccgctgcgccttctgtttaaggatgaggtaagaaaggccggtctggaacttggaattccggagtatttggtttaccgccagccgttcccgggcccgggcctgggcgtgcgcatcatcggcgagatcacaccggacaaggtaaaaatcgttcaggaagccgatgcaatctaccgcgaggagattgcaaaagccggagtcgataagggactcggccagtatttcgcagcgctgacgaatatgcggtcggttggctgcatgggtgatgagagaacgtacgattatgccgttgtattgagagctgtgcttacatctgattttatgactgcggagtcggcagaacttccgtgggaggtcctgggaactgtgaccaggagaattgtcaatgaagtgaagggcgtgaaccgggtgctgtatgattgtacggggaagccgccggctacgattgagtttgaataggaaacagagagccgggaagccgcataaacagcggattttccggctcctagtatgtgtcgtgatacctttttgatacctatatcttgattattcatctggtttgcactataatctgtaatgtaatcaaagagcctttgattgttggcttggcaattttttcgtgcgcttcgtttgaatttgagttcaatctttcagaaaaagtaaaagcaaaaatttgtatggagggaagaaggattatgataatgatgattgcatgtattaaaatggtggttgtgggcgtttgtggagtgtgccctgctaagtcaatttagataaggattaaacgccgaggggttcaaatcccctgcactccattaaagtaggctaccgaaatggtagcctcagactgtagacaactagcctcctaataggaggcggttgtctttttttctttaactcaggttttcgatgtagtataatagtgctatacgaaagtgaggttttttcttatgatggggaaaaaagattattcagaacgttctcaggtgcagattgcaagcctggatgacctcgtcccttccggtcatctggttcgcaagctggaagaagccattgatttaagctttatttatgacgaggtcaaagatctctacaaaccttatggcagggaaagcattgatccggttgtattaatgaaaatcgtgatcctccaatacgtgtttggcatcccttctatgcgcaaaaccatcaaagagattgaagtgaatcttgcttaccgctggtatctgggatacggcctgtatgaggatatccctcatttctctacctttggaaagaactataccagacgatttaaggatacggatctttttcaaaagatattctcccggattctaatggaggtggatgcctgtggtttcctggatacggaaagcctttttatcgatggcacccacatcaaagccagtgcaaaccctcataaataccagaatgaaaccatgaaaaaagaagcccggtgttacgaaaaggagctgctggaggaaatagagaaggacaggctggagcatggaaaaaagccattgaaagaaaaagagtccacgccacagactataaacaaaaaggtcagcgctaccgatcctgacagtggctggttccataaaggggaacacaagcaggtgttcgcttatgcagccaatacctgttgtgacaaaaataattatgtcatagattttgaagtgacagcggggaatgtccacgacagtgtatccttctgggaactgtaccggagagtaagcggacgggtaaaatatcccaaatactatgtaatggatgcaggctataagataccggcaatcgcaagaaggctaatcgaggatggaaaggttccggttatgccctataaacgcccaatgacaaagaaagggtattttcgaaaaagcgattatgtatatgatgaatactttgactgttatttatgcccaaataaccagatactaaaatacagcacaacaaaccgtgatggataccgagaatacaaaagcgaaggaaaaaagtgtaaggattgtccgtaccaaaaccaatgtacaggaagcaaagaccatgtaaaggtggtaagccgccatgtatgggaggggtacatggaagaggtggaggagatccgtcatcagacagggatgaaagaaatctatcagaaacggaaagaaaccatcgaacgggtctttgcagacggaaaagaaaaacatggaatgagatatacacagtacagaggattggcaaaagtgacaatggagctgacccttttatttgcatgtatgaatctaaagaaactggcaatctggaaatggagaaagggtgggctaaggaaaccctgttcttttgtctggatattcgaaccaatatatttatatataaaattcaaaatggttcctggtgcgatgcacccggaaccattttgtctacagtctgaggctaccgaaatggtagcctttccttatgccctattttcttttccattgatagctgttatttttcttgtcgtttcccttttcatcaatggtactgctggaagcaggccagttgattttccattcaaaatattcgtcctctgaaatctctccgctttatagctgttctttccgcaaacactattcacgcagaaattcatttacaagaccataatcaatccacatacccacaggagaatgagcaggccattcgtcactatcattatagcgaacagacttatcatcagaagcattgcatttgccgggattacggacaagttgaaacagatgaaaggtgttgcggttgtcctcgtcaagccagaaaaaagtctgcataatgtcctcggcgcaactaggggcttcggtaacaaaattgatatagttgacattcaaaatcttggcaatttccatgagagtgtcttttttgggaacacgatagctggattcatattgcgctacacgaacatcagcattgcgttcctgatatcctagcttcaagcctagttcccgttgtgttaatccccgaaatgtgcggattctcttaattcgttctcccagtatcataatcctgcgtcctttctgaaaattatatagatagcaataaacatacagcgtggcaaactgccataattaacggtccaactgtacgcattttactttttataacgataccgataatacagtcaactatctgtactatcagcattgccattgtagcaacgaataaaatagtaggtgcatttctgcatataggaatgactgcggcacacgttaaagcaaggcttctggcgaacatatacagggcatttgtcctactggtttccgtttctgttatgaccgctcctattgagaaacaaacgcccagaacggcactgattagtgttgtgtatgcgtttatatagtatatcaatgtctgtcctcccgccatagcataatccattcgtctccgttttcctttataatttcaaatcctatttttcgatacatttcagccgcataattagccttttgaacggaaagcgaaacacgtttataaccatgtgttttcaacaaagacagcatttctttcatcatattggttcctatcccctgccctctgtatggatctatgtcaatactttggacaaaaaaagttgaaagattatgccactcttttaagttcctcatcctctttttgctgaggcgtcatataatctatggcactgtgaatccgtttacggatataccaggattctatatactcgaaaattgccctgcgggcttccttaaagtcttgatagatatgaagatagacttcctccttctttaataccgaatggaaggattcgatacaggcattgtcatagggattcccttttctgctgaaggaatgaaccagccccctcttggataaataatcctcaaacatctgactggtatactggcttcccaaatcgctgtggagaataatccctttcgtatccttcacattcaggcaggcattttttactgcctgcactgccagctccgctgtcatggtggttccgtaggcgtagccgataattttacggctgcataagtctatcacggaggccagataagtccagccttctttcagcacatgaatataggtaatatctgtacaccattttctattgatggtttctgcctggaaatcgcgctttagtatattttctttgtcagccggaacagttccctgattggcgtgatgattgtattttttcacaactacggagcgcagcccctgtgccgccatatggcgctgtacccgcttcagactgcagactataccgttatcgtttagggaacggcagattttgactgcaccgtagcgttgttttgattcatcataaatctgttttacctgtttactgaatgttttatatttcttctggcgattagaaggtacacaaaccagagccttgtaataggtactccttggaaatttcaaggcgctgcaaagctgggatacggtgtagtcattcaagttgtcctttataaaagtcacaatcttggttattgttcttttgcgaatatggcggtcgctttttttaatatttcattctcaatcttaaggcgctgtatctctttctgtaaagcccggtattctttgagggtaacggattcatcttccgatacttttataggggaaagctgctttacccagctgctgagtgtactccgatttatgccatatgcgcgctccagttgtggatacgaggttcctccggcattgtacagatccacgatctgctgcttaaattccggagtgtaatgtctttggtttttcgccatgttgaacatctcctttactctttcaattgctattatagatcgttcaactttttgtgtccactcttatatactaacaccatacagatacggaagtacgcaatctgcttgactggatatgtgtatcggagcagataaaatcaaacaataatgagatacgaagtctgaccggggaatataagcggatagagctggattgccgggagggtgtaagggcgcagttggagcgcatgaaatcactctgtaaagaacgtgacagcttgtatgagaagcagaatgatttaaaagggcagaaacagaaaatcgagagagtattgggacggtaggaatttggagcatggcgacgccgtgtctcttatttcttgtggcaaggcatgtgatgatgtgctatacttagaataataaattggaagtttttgtgcagtaagaaattaattaagccagtgataagtctgtagtttaagataaaggagaaggtttatggagtttcccaaacagttaaaagatcaagtgtatgtattattgcaagaacccacgcttgataaatttagagagtttttgcatgcacagatgggtgagcataatgctattgatttcaaaagtcaatggattgaagatgccgctttagcaaaagaaatgttagcgttagcaaattcacagggtggtttcatcatatttggagtggcagaaaacgaagataaaagtatacgtgttgatggcttgccggaaatcaaagataaagctgttatttcaaacggtataaagaaatttatatcatcaaatttaaaatatgagatttatgacttttcgtatactacatcagaatacgaagcattaaacaataaaaaatttcaaatgttggttatagaggatacaccagaatatatcccttttttatctaaaaaggatagcggctcccttaaacaaaatatgatttatgttcgtcgtgggacttcttgcgaaattgcggacgaagaagaaatacaagtaatacttaacagacgaatgaactatttgcatccattaaatggagagccgcttaaattagaagagcatctagaacaactaaaaattctttatgaaaagattgaaaaaaatcatatatactataaaaatggtctttcggatggaatgagttcttttttggcatctattgctaaagtgattacgaaaggggagaaagtggttgaacctaatcccctttatcctgacgagagctatgaacaatttatttcaagaatgattgttgaaaaaaagaaaaaaatcgaacgagtactagatttgtattgaatatattcatgcttatgagttgataagagtgaagtgctaaaacattgacacaaacctttcggttatatggagattaataattcctattctcaatttccgtttgttaagtgaacaaattcgctaattgtcgggaatatggttgcgaagcaatgttacgtttttaaacctctggaatgcttattttataagggtttgaaatggcaaaaatgacattggagatagtttgtactttatcattcaaatgagagctttactgcgtaacgggagcgatttcatatctccttgttgaatataaatacatggtgctagcaccatgtagatagggcgattaaggagaaatatttgtgatacccgtatgatacctgtttggtcggaaactatgaataaggcgtgaaatttggatattatgaatatgaaaatcttcaaataataatcacatatttaacaattatgttatgtatgtagggagtttgaatagcagacagtgtcgtagggagagcgtatttattcccgatcggctatattaatttagcaccaatagcattgaaaaatatggcctttcacttaactgtgcgaggccatatttttgtcgatttagtacagaggcgtggcacatctctgtatgcaccatcgataaatggaaggtatcggagatatatccggacaggcagtactggaaaaattgttctatgagtcttttctgccctaatcactccccgtcccacaactctgtctatacgcaccaggtgacatcccataccgtctctgaaaaattcgattaaaaaagccataattggaatatcccaaccgactgcagatttccgatatggatagagaggtatggctgagtagctttgcggcttcctgcatccggaagtttcttgcatattctgataaggtatatccaaagtgtttcttaataacgcgattcatgtaatcgccattgtaattaagcgcctcctccagctcctggcggttgattattccgtgacgctgttccagtaataaactgattcgataaacaagatcttcttctttggaaagtactgctcgatgcgattgtatctgataaatgccttcattttcaagcaggttaataaaacggcagatatagcccatcaggaggtggcgtcttccggctctgtattcggaaaattcattgatcaatgcgttgataatagcgtaaaagggttcggaatggaaggaactgtttatccgaaaatctatatattccttggctgtataaaaagaaatttccttatttttagcgaaaagcatgtgaaacagggaacttctagtgtacgggcatccgttttcgtcatagagaatatcctgttccagggcctttttgatatagtcttccttaagcatgaacagaatcagttcaaaatcagtatccatgatttctttatgatggatatttctgttgcacaggcagcattctcccatgtgataggtttgaacttcattttcgatgcatatttttatttctccagagagaaccacagtcagttcatagaaatcatgagtatgtaaaggccgctcaccaagcttctccagttcatggatagaagaatagagatagtttttactgttttccgtaaattcaaaggaaacggtccgaccggttttggtatccagggactcatacatgatcatgtacggcatgccgatttccaggtattcgacaatcttacttccaaaattgtgataggtcaaataagacttttgtattccatactgctgtaaatatttttctgatgaaataacaggattatttgcgatttgtgcagaatcagtcagttgtgctgtatttttcttcatatgcaccccttctttctcccatctttccattttatcctatcaaccttatcttatccaatactaaaattcataaaagtctgaataagacacaataaggcagaaaacagtctaattacgatatagctattgtaccatatatttaataaaatacaagtacagggcaggaaattaagcaaatgtaacaaggaaataggcagcctgctccataacatgttatgggtaacacaattttgcccgacgggggaataaagcagaaaaaggagaagaaaaatgggagagaagaagtatttaaatttcctgaataagtttggatatggaacgggagattttgcggcgaacatggtttacggcatcgtgaccagttttgtaatgatttatctgaccaatacagttggacttgatgcaggaattatcggcacgttaattatgctttctaaatttgccgacggagttacggatgtatgtttcggtacctttatagaccgcacacacagtaaaatgggaaaagcccggccgtggatgctgttttcctatatcggaaatgcgctgtttttgattctgctgtttgcaattccgctggaaatgggtaaaacagctcagtatgtatatttctttatcgcttatacgttactgaatgcagtcttctacactgcaaacaatatcgcctattcggcattgacttcattgatcaccagaaatggaaacgagagagtgcagttaggaacttatcgatttattttttcgacacttgcaaatttaatcgtttcgaatatcacattaaatgcagtggaagctttcggcggaggggcggcaggctggagaacagttgcggtagtgtacgcgattatcggtgtggttgtaaacacatttgcagttatgacggtgaaagaacttccagaagaagagcacagcaatacaaaggctgtaaaaacggagaagatctcaataattaattccctgaaaatattattggaaaataaatatttcgacatgcttacgattctttacgttctggcatatttaagcgttgcgctgtccatgggagttgcggtttacttttttatctatgtaatgggggatccaaatctattcggacagtcaatgacaatcttttccattgcaagtgtcgttggtctgattattgtaccaatgattgttaaaaagtttgcaagcatcagaaaagtaaatttatactcgtttatgatacaggttttattcagaattttgtttatcgcggctgcggtatccagaaatattactctgatgttccttacatatggtctgtgttcattgacaaactgctctttggcaggaacctttaatgcgttggttgcagaagctgccgagtataccaggctaaagaaagggacaagactcgatggatcaatgtattcctgtacttcctttggtatgaaagtggggagtggaatcggttccgggatcagtggatggcttctggcagcaagcggatttgatgcatcggcggcagtccagacggcggcatgcaatcaaatgctgctgattatgtatgcggttgttccgctgattgtgaccatcatcagcgtagtaatttactattttctaaaggtagaggatgccaataaggagctgcggcaggcagcagaaaatgaatagaagaggtgacggaatatgaaatgcacaaaggaacatcgattatcatttacagaaaaagcaaaaaaaattgtggactcattaacgctggaggaaaaagtatcgcttatgagcggttcctgcactttgcaggatatgattaccgaaatgcaggaaaacccggatgcacattacaatcacaaaccatacagagcgggaggcattgaggaaaaagggattccgcctatgctgttctgtgatggtcctcgcggtgtcgtatgcggaatgcggaaagcaacctgcttcccggtatccatgctgcgcggcgccagttttgatatcgaactggaggaacagatcggggaagcaataggtcgtgaggtcagggcttttggaggcaatctttttgctggtgtctgcatcaatctcccctacaatcctggatggggaagaagccaggaaacgtatggggaagagtcttttcatctgggggaaatgggaaaggctctgattatgggcgttcaggaagaaaacgtactggcctgtgttaagcattatgcatttaatcagatggaggtgtccagattcaaggttagtgtcgactgtgataaaagaacggaacgagaggtatttttgcctcattttaaaaaatgtgttgatgcaggtgccgcctctgtaatgagttcctataatttgtaccagggagtcaaatgtggtcatcacaactatctcttaaatgaagtccttaaaaaagagtgggattttgatggttttattatgagtgattttggatttggtgttaccgacacggtagaggctgtgaacggcggtcagaatatggaaatgtgcggtaccgtattttttggtaacaaactggtcgaggccgtacgtgaaggcaaagtgccggaaaaaaacattgatgattctgcgctgagaattgtcagaaccctgttggcctttgaagatgcttatgacaaggaatacgactgctctacactggcatgcaaaaagcatattgatctggcgcttaagtcggctcgggaaggaatcacactgattcaaaatgagaacaatgttcttccctttgatctgaagaaaaacaggaagatccttgtattgggaaaactggccaacatggaaaacatcggcgatcacggatccagtgaagttcatccgccgtatatcgtgacgccattagagggtattattcgtgaagctcaggaaacggaagtgatttattacgaaggccagaatcatgaccgtgcgaaagagctggccagagaggcagacgcagtgattttcgtagtcggctataattacaacgatgagggagaatactgtgcggaagatgatctggatcaatatctgcagggggttggaggggaccgtgaagtgtctctggatcttcataaagaagaaattgatctgatcaatacggtgggatcagttaaccccaattcagtagccgtattaatgggcggaaacatgattatgatggaatcctggaagaaatcggtgagtgcggtaatgatggcattttatccggggatggaaggtggtactgcaatcgcggagattattttcggtaagatcaatccaagtgggaagctgccttatgtagttccagtgaaagagtcggacttaccccaggttaactggcggacctccgaacagcattacgactattaccatggatatgcgaaactggagaaagagggaattgagccgtctattccctatggatttggtttgtcctatacaacatttcagttcagcaatgcctccttttatgttaaggatggtatcgtaagcgcggagtgtgatgtcaggaataccggagaccgggacgggacggaagtagtacagatgtatgcaggctttaagcactcttcagtagaccggccggttaaggttctgagaggatttaagagggtggacttaaaggcgggagagagtaagcgggttgaaattaattgtccggcggaggagttgaaatggtttaatcccgatactaatcagtttgagctggagcatatgaaatatgaagtatatattggcagcagttcttctgaccgagatttgatagaagggggtgtggaattataaaacaccataaggtcttgagatctcccttcatttgtgcatgtaatcaaatacgaaaagctatgataagaaatagtaggtattccagactttacagagagaaagcggttggtgcgagcattcattgaaggagtagcgaaccggtctttgaactgtgggatgaacggaacgtagatatcccagtaggtttcaccggggtctcccgtcacagagaaagagtagcaggcagtctgccccgtactcgcgagcgcggatttattccgaatttaggtggtaccacggacttttgtacagttcgccctaagctgatgagcgtcagcttggggcattttttagtttgtggaaaatgaaaaagggaggaaatcatatgaaactgaaaaacttgtaggggatcggtgtgggccggcttgctgccgctgtatgaggaattgcagagcaggggcgtggaggtgatctatgacgaccgccaggtaagcgccggcatcatgttttccgatgcggatctgctgggagttccgctgcgagtcattgtcagcccgaggaatctgaaacagaatattctggaggtggtttccagggataagcgcttttcagagaaaatagcgatggagcatgcggtggaaacgttactgcagctcgtaaatgatcgctaaaaggcctggtgactaatcaatacgctgatacagatagtaaaaagggcctgcgtgtgttaaaatgagcgaaacggctttatatggaagcttaggggaggaaaataagatgaaaacacctttattagagacggaaaggctgcttttgcggccattttgcgaagcagatgcacagcgggtcttcgattgctgggaaagcgacccggatgtggcgcggtatatgttttggagcagtcataatgacgttgagaagaccaggcagtggactgccttcgaagtctctcagataccatcggatcagtggtaccgctgggccgtggtgcttaaagcgactggggacctgattggaaccggacttgtatattacgaagaggaataccatttatttgaaataggttataatttcggaaaagaatactggggatatggatttgcgacagaaacgatggaagcaattgtggattttgcaaagaatgtcctgaaggtaaaggagctggtgggcaggtacgcaaaggagaatccggcgtcgggccgtgtgatggataagctgggattccggtatttcagagagattccttatgaggcgaacgaaggaaaacaccgatacgatggggtagagtgcaggctgaagttctaaaaggatataaaatcatgaaaaaatatttgtctgctgcaacattttatcaggctcatctgtatagaagacagaacggctaagaaagctgttaaaattccaaaaacagcctgcaaataaaaagtcaatagtataatgaaaagttttaagagttattgttgatgaaatttcaagtacaacaaatagaccaccgttatccgctggtctgaaaggttgtggcattctttattctggaagagacataagatattcttttactcttccgtaatagatacgcagaaacttattagcacctgcggtcatgtagacatagtaaggttttccctgagcccgtttcttgtcaataaacgcatatacagggtcatcctgcggctttgttttgacgagacagtccatgacctggaacaaagtctttctaagggaagatgagcctcgcttggaaattggaacgcttttctgttcataagttcctgattcatttacgcctggatccacaccggcaaatgcggtgatagctcctttatgagtgaagcgtgtaacatctccgatttcagccataagctgagggccaagtgatgggccaacgcctttcatttccatgacaacgggatattcaggcagcttagaggcagtttcattcatcagggtacggagttcttccacggttttggaagcagtgtttaattgttctatggcctgtttcacaatcagcttggttaaatcatctttcggaagtacaggaacaagctctttggcagctccatagatttcttcagccttgtctttactgaagttgtacatcctgcgtttgcaccatttctgataatggccgacaaatgcgtttaatgacagtttacggacacagtccacatgccagtatgtagtggcaaaatcaacccacttctggctgccgtcctcacgggcagggctatcaaagaaagtattaacacaagggtaagtctgatcgaggataccgatgaggttattcttcatagctgttttgtgtttcatatagaacccaaactgacggttcatagtctttaattgattgcgtagttcgtccataagactatactgtttcaaatcaatccagttgtcaagtgtataacgggctatttttacagcatcagctttatccgattttactttacggagagaattatttccgaaatctttaatgagcttaggatttacagcagtcacaaaaaggccagcgagagaaagctgacgggcaagtggttcgtaataacggccagtatgctccataacgatgcgggagttaccttcgatagaattaatccgttcaatcagagattggatgttagaagatgtatgtttgatttcaaacggtgaagaaacaatctcgccataagggcgaagaatagcaaccatgctcttgcctttggaaacatcaatacctactgcgttcatattcataaacttgtcactccttaagattactgcaatggataagtaccagtttaactcattgcctattccatctactgtggtgtgacacgaacgtaccggaggcagttcaacctgcataaaacgaacgctgcgaatgaggagctggttatcagtctgtttttacggacgcaaagtccaggaaaggaagccgatataccgattgctccatcattataacagcttaagcaacaagatggataagtccttactggctgtaaggaatattaaccataaatatattgtagtagaaaggataaatattatgaagaaaatgatgactctaactatttgtgcagtggtggcgctgtcaatcactgcctgcgcttccagcggtgccgctgcaaagactccaataacagagacaacagctataacagaaacaaccgctataacagagacaactgctataacagaaacaactgctataacagagacaactgctataacaaaatcaacaactccgacgaataccagtcctgacacaatgattgccaaccctttcgtggattgccagactatggagactgccgccgaggtggctggatttgagtttcgcacgccggaacaggtggaaggcatctcagaaaaaaagatacaggctgtggatcaggagatgatccaggttatctattcagcggatgaaaatcagattttgatccgtaaggcaccgggaacaaggaatataagtggggattataacaactatcagaaagaagaaaccatcacggtggatgaaatgcaggtgactttaaaaggaaatgatggcgtcatctctctcgccacctggtctgcaaacgattactcttactccatttatgtgagcgcgggcatggctcaggacagtatcgtaagtctggtacaggcgattcattaaaataagactgcacaggcaatggcgggaacatttccggcattgcctgtctttgtgggagagacagtgatggaagtatgtatttatttgaagaggggatggaaggactgtatgatctctttcctccgtaatatatgcagctataaacaatcccggcggcgtatcttgtttgccaatgaagcaaaggctgctttcggggagtttgccaataaaacaaaggcttcttccggggagtttgccaataaagcaaaggctgtttccgggggaaatgccgctaaccgggaagcggtcaatatgcaggcggccagagtactcgatgaatatggaaacagtattttgcgtctggcttattcctatctgcataatatgagcgatgccgaggacatcttacaggagacgttgattcagtttttaaagacgggccccttactggaaaatacctcgcacgaaaaggcatggctgcttaaagttgctgctaatttaagtaagaactgtattgaatacaaccggatcaggcagacggatgaattggaagaaacgctggccgcagactgcagggaggatttgtcctttgtatgggaggcggtgaaagcgctgcctgacaaataccgtgaggtcatacacctgtttcactatgaaggatattctacggcacagataggaaaaatgctcaatagaaaagaagcaaccgttcggtcggatctgcggcgtggaaggcagaaattaaaggatattttgaaggaggcatatgattttgggtaaatacaaagaacttatcgaaagagtagaagtaaccgatgatatgcgctgccgtatccttgataatgtcagcagagaaccgatagagaggccggaaaggatgcttccgttggccggcctcagaaggtacatggccgttgcagcctgttttgtcatcctggcagcaggcgcagttatgattcctgcggttctgcatcataatccgtcatcgccggatcaaggcgtgcttacggcgccggtgttgttaaatgccgcttccgcagtggaactgtcagaaatggtgggattcggcgttgctgatatcccgtcccttatgtctgcatcggacaaaaccacttatatggcattgggaaaggaactggccgaaataaaatacaactccggcagccagaccgtcacatttagaaagtccgctaaaatggatgataattcaggtgattacaatagttacagtaccgtgaaggtgattaccataaatatggattccgtcacgctgaagggaaatgacggtaattataatctcgcggtctggtcaaagggagagtactcttattccctgcattttacagaaatggtgacggaagaagcggttaaacagatcgtagaggagatagacgcaagatgacgttcggggcggagatattattttaacctggtgatagactccatcactgcaggcatcatcaccgcccttcactgcctcacccgttatgactgcagacacaacgatacatctcagacaattgtttggaatactgttccatcaacacagataaccggggttccccttccatcgtccgtttatagatgatctccggggatacggtgcgattcctgtcagctttcatatgaagcatctcctggatttcgcttaaaatacaggcggtaaaggccagatagtcttccatctgtgcagaattaaccgcactggcttttctgttgttgattaagaaaagcatttgttccgcctcggatatcatgtgccaggaaatccatagaagttttttgataaaggccgaatcctcatttcccgcctttttcaaatactggataatctggtcgtgaatcagatggtaatggatctggacatcgcagatgacgccataatccagaggcgcggtcaggctgctctccagcaggcgaaggtaaacgtggtgtgtgtggaacagctgatacaggttgtagcggtactgtcccttctggtgcgtaggaaatacaaaacggtttacgagaagtaccagcaccatcgcagcgacgacatataggatacggagttcagcggccagcatctgtgggagtgccagcgtggtaagggtcagggcaaagcaggtggagaacagggcctgctgccaggttccggccgtttccatataaagccctgtcgccataacggtcgccagtacaaaatgccagccggttccatggaacagcgggaggagaaactgcaggataagacagcctgccagtgtgccgataaagcgggtcttgatgcgggtggcgctttcctcatacatggggcggagcagcaggaaggcgttcagcacgagccagtaaccatgatttgcctggctgaccatgctgtaagtaaagccaacggtcaaaactacgctgagacgaagcgcaaaacgcgtctcaaatgcatccgcttttatctggccaaacagtttccttaaggggcggcggtagcttggaagtctccaacagggaggactctgtttttcacctgtctgtcgaatgttttccaggatcagcaggaagagacggagaaaattctgaacaaaaatgcaggggatttcatcgcgttcctccgcttcggccagaagcttatttcctgtgctgaccagttctttccgttcaaaaccgccgtttcccgcggactccatatattgggccaggcgttccaacaagtcatggcaggtctggtcagagagcgtggctgcctggtaaggatttgtcagaaaatacacggcacgctgaaacagcagcgcaaacatatactgaattttcccctgggggcttaccacataggtgaggcccctgcttttgtaggcttctccgtaaagtccctggaggattggaaagatggtatccatctgtccggaagccagactgccggaggggtctgtttgttctgcggagggggacatctgctcaatctgagcgcgcagtgcggccgccaggagcaggagcccctttttggcagcagcaaaatggtcattttttctattctgaaacgaacagaagaacagtatgatggtcagaaccgccagaccgtaggccagcgcccccatctgcatggccagtccatcccacccgaccggccgcagctgaagaaagacaaagcacatggcattcgcaaaatatcccagcggattaaactgcgaggtctggagaaaaaccagcagaaagggaacggtcaggttgagaagaatgcagagcgcaacgctgagggaggcaaaaaagctgagaagagccatcaaaaactgcgtccccacaagaacgatcagctgccggactgttagatatttccgataattgaccttgaacaggattgtaaccaccgatacgaggattgaataggaaatgccgaataataggatcgtagagtaaaataaaaaaaggaaaaaaagaataattggcagggcggccgcgaatttggagcggaaagctgccaatactgattttgttttgtttttcatgggtgaagtcatctcctttaaggagatattataactctaatggggacggctgtcatcttttttgtgaagagggcatgaacctgtcctatatcagaaggatactgtactgcagaacggacgtaaaacagtttgcctgattagcgtccgttctgtggcttcataagtattagtcagtggaagtatccggtggtttttcccgatactgcactggagtaacccccatatatgttttaaaaacagtcaaaaaataattataactctgaaatccggactcttcggctatctttttaagggaatcattggactgccggaggaggtgtgcggcgattctgacccggtatgcgtttaaatatttcgtaaaagggaggccaagcgcgtctttgaatgccctggaaaagtagacctccgacactccgcagtggcggctgatatccgacagagagagatccagataatagttttgatagatgtaattcagcgccttctggatcagcggcgggtattgggagaccgaggcggacgcaagccgttccaggccctggcggtaataaaggagaaactgttttttcagcgtctcaatatccaggatattgttgacagccgacggcggtaccgtgatggtctcacgatcctgggaggccgttcggagagccagctgcatgatctccgtcagacgcaggacgaggcgctgaagtccaagaagagagacgtgcgtctgtccgactgtatcaaaaatatgagtgacgatttcagtcacttttttttcgttcaggtgaagaagagattctgacagctcaagaaacggtaaagggaatacgggaaaggatggcgaagcagtagacgtggacagcggaaagaaaaaaaataatttcctgatatttatgacagaccagcagctggggacgacccaacagagcaagggaccggcatacatgccgaatctggagcggttaaagcgccatggtgtaacttttcaagaggcgtattgtccctctccccactgctgccccagccgtgccagcttcttttccgggttgtatccctcagagcacggcatatggaacaatattgatctggcggatgcattttcccacggtttaaatgacgggattaagctgttttcagaagatttgaaggaagcgggatatcagatgtatttcagtgggaaatggcatgtcagcgcggaagaagggccgggcgatcgaggatttggtccctggatctatccgccgcaggagggccggtataagccatggaagaggactccctttatgggagactgggattggcttttagaggaagacgacattgctctagaagaggggcgcagagaaggggaaatctccagaattggatttcctcagtacagccagtacggtgtgacggaaaatcccttcggtgacggtgatgttgtatcctgtgcagaaggctggctggagaatgtgagcaaagatgaaccattctgtatgtatgtcggaacactggggcctcacgatccgtactttgtcccacagcagtatctggatctctatccggatgaatcgatagtgctcccggagtcctggaaggaccggatgctcgataaaccaaatctctacagaaggacgagagagcggtttgaccaactcggcgaggcggaacagaaacgttccctgaagcattacctggccttctgctcctatgaggatgcgctgttcggaaggcttctcgacgtgctggagcggagagagcttcttgaagatacggtgatcctatacgtatcggatcacggagattatgccggcgcccatggattatggacgaaaggccttccgtgttttaaggaggcgtaccacatctgttccgtcatagggtatggcggtattaaggcggaagggggtgtggtcagccatagagtgtcacttctggattatgcgccgacatttttagaactggccggaatattggaggtggatgatgtggaagtgaaacggcggttttcaggccgttccttaaagccatttctggaggggaacattccagaaaaatggcgctcggagacctatacacagagcaatggaaacgagtgctatggaattcagaggagtatttttacagacgaatatcatttcgtttttaatggatttgatttcgatgaactgtatgatttgaaaaaagacccggactgcatgaaaaatgtgatagaggaacatgagtatgaggcggttatctatgatctatacaagaaattgtggaaatttgcatatctgcatcgggacgctttgggagatccatatattacgaccgcgctggcacggtatggccctgggataatcaggggagtgaaacgggaaaagaaaaagaagagagaataggaatagtaacggaaaatgaaatactgccggaaacttttggaagcatatgttactgcatgtaaaagtttctgacagtattttttgatgtgataataagatagtggtttgcgttttgcttaaaaatatataatttgtattgaaataaggcgaccgtaatcccactggctttagacagtggggtagatcgccaaaagtgtattttagtggtatacagttgacatggaaacatggagatgcaggagttagagttacataaggagggaggcggtcatgcatggtggttggaagaatgtatatgatttgagggaacctctattgacatttcagggagatactattcggaaaaatacgctaaagagcataattacatttgcacaagtccgcttatgacagctacaacaccgagaacaagagaaatcagcccaatgtttacggcaccttttttcttattcgagcctctgtctttactcttaaatagtagaatagcgcccaatacgatgagcacaataccaaagccaacactaaaaacatatagcccggacgataagctttcaagaccactgtctattgcgccctcaattttctgttccatttattcaacctccattctgttcacctgcttcattaaaagtattgaaactataaatgcaatagacaggattactattgcaaacaaatacattactgctttattcgctgtggcatttacaacgatattgcacaggagagaagcaatatcgttgtgggcactgatttttttataaatccaatgccggctgatataatgcctatgctggcagcgatgaaggacatgataagtgtaatttcaatcgcctgcgctagaataaaaagtgtaaaactttcatttacaaggtgtataaattgttcagttagaccaaatataaggaatatagcaatgttactgacagtcattgatattacggtaaaaagacatacaataccaagctttgataacagaattttttttcggcttacggggtaagagaaaagtaaaattatgcgttttccggtgtattcttcaatgatgaattttgaatacatcactgccgataatacacaaaacacggccatattcaaaacaccaaacagcggaataagattatggtagcccgaaaaaatagccatatctttatcgttaggctccagcataggcgcatatgcaaaaaggtacaggaagcccaacattgtaaatgcaatggcaagagaggctgccacataagtacgaattttgtttttttgcagttccaactcaaatagtattttcattttctttcctcccggtcatgatatccatgaaataatcctcaaggccagagggggactctgatttcagttcagccatggaaacctctcttacgatggttccgtctttgattattccaatggtgtcggctatgtgttcaatttccgtcagaatgtgactggaaatgagcagggtcatgttttgctcttttacaagcgctatgaaaaaatcccgcatttctctaattcccatagggtcaagtccgttaataggttcatctaaaattagtagttcaggtttatggatgatagcccttgcaatcgccagccgctgccgcatacccaaagaaaattttgaaacaggctgaacgcctgtattactcagtccgacctttgatagaacagcgtcaatatcccccggcttctttttcatgtaggcaagatggattcccaaattcccggccgctgataagtgttcataaaatatggggggttcaatgattgttccaattttggataagataatatcgcgttcagaaacaatgtcttttcctaaaacctgcgcgttacccattgtcggtgtaagcagcccggatattattttgaaaagcgtcgttttcccagccccatttggccccaaaaggccgtaaattgttccgcgctcaacgttcatattgcaatttttaacggcttcatttccagggaaaacctttgtcagttttttcgtttgtacagctaaggatttattcattgaaatggacttcctccgtgtatagcttttgcaacaggtctaaagttctttcgagaagcgtatcgctcaatacatctatgccgatagatttcatcagatgctgtaaaaatcttaatcgaagtgataatttccgggtatcacaacgaaagacagcaggatcgcaccatacgttcatcagtaaaagaaaaacttcggcacactcatcgggaaaatctgtaacgatcgaaccatcggttataccttgctgaattatgtttgagatgagggcggcatcttgattgacacaggtctgcatataggacaagacaaattctgcgcttttcatacggccactcattacttcatctaaataatgagcgtcctggcagtcaaggtttttttctaaaatggcagctagttgttcttttcctgtaagagcgcctgtttcagacaaccagctttcaagcatggacttagtagtctgtgtttggttttcagtgactgcgctgataatttcatcttttgacttaaagtgatgataaatagctccttttgatataccggctgcttccgctatatcctgaatacttgttttatcaaatcccttttctaaaaacaactttgcggaaaccattaatatgttttcaatggttgcctgtgaattatattttttcggcataggatgctccttttaataaaaaccggacgttcggtttttatttattatataccacattatctgttttgtcaaatttatttggcgtgttgataaaccaatgattttcacacagcttctggagccagcctggttccatgtaatcaatcaggctatcaatattaattttgtcgtcgtgacctcctgcattactctttttcccttccgatactcggcatagaaggctttttctttctatgtttcacagaaaagtcaccagattccacctgtcctttcagcttactttcagcttttcatgctaggataaaaacaccttaaggaaacaaataacaggtcattacgcattttattgaatacacaaatagtgattgtacagagaaaaggaggcaggaccgacatggcacaggaaatttttgaacgttatgaaaagaaatatctgctgacagaagcacagtacctcggtctgaaacgggtgtttgaggacaggatggcagccgatgcatatggagtacataccatttccaatatttattttgacacaaaggattttgaactgatcagaacgtccctggatgggcctgtatacaaagaaaagcttcgtctgcgggcttatggggcggtgaacgaaaagagtacggtatttctggaaatgaagaagaaatacagcggtgtggtatataaaagacgtgtaccaatggaacttgtgtctgccgttttgtatttaaataacgggattcttccagagtcggaaaaccagattttccgggaaatacagtacatgaaacagaggtatcatctggaaccggcggcatatgtggcttatgaccgcttggcgtgttactgtaaaaccgatgaagaactgcgggtaacctttgactggaatatacgatgcagaaacgaagcgttagatctgcgggccggggcatatgggaattccctgcttgatgcaggctgtgtcctgatggaagtaaagataccgggagcaatgccggtctggatgagccgggcattttcggagctttccatctatcccgtgtcattctcgaagtatgggcgttactacagggagtatctgctgagagaggaaggggcggaacccgaatacaaacaaaacactataaaaggagggcgtgtctgtgcttaacagtattttgacggaaacagtcagctctgggattacattgccgcagctggttatatgtaccttgacttcactgggacttgggcttgctctggcattccttcatacatatagaaatacaagttcaagaaattttgtgatgacgttagcgattctcccggctgtggtacaggcggtgattatgctggtcaacggaaatctgggaacaggtgtcgcggtaatgggcgcgttcgggctggtgcgtttccggtctgcgccgggaaatgccagagaaattggaagcgtgtttcttaccatggccatcggcctggcgacaggaatggggtatctgggaatcgctgttctcctgcttatcataatcggagcagcaattctagttttggcggcggttccttttggcagccagtcatttgcgcagaaagaactgaaagtcaccataccggaaaatctggattatgccggaattttcgatgacttattcgaaaagtatacgaagcgtgcggtgctcatgaaggtacgcacaacaaatatgggaagtctttatgagctctgctaccggatcgaactgaaaaaggaagaggaggagaaggcgatgctcgacgatattcggtgcagaaatggaaatctgacgattgtgtgcggccggatagcagagaacagagaagaattgtaaatgagaaatatacatttaaggctccatttttttacagggactgatattacaagagtgaaaggagagatgggatgaatcaattattgagacgcggtctgtttctcgttatggcgggagcaattctaatgactggatgccagagcaaaaacggagatcaggccttcgaagatactgaggcagaaggcaatggaagtgccgtgggagcagaaaccgtgataaccggaaagggcgattctgtctcagtgaccggaacgggagccgcggtggatcagcgtgtcgtgacgataacggcggcgggaacgtaccggctcagcggagagattacagacggccagattgcagtaaatgcaggcaaggaggacgaggtccgcctgattctggatggctttacaatatccaatgccagctcgtccgctgtctatggaataaaaagcggcagtatcacaattaccacggaagagggaacagataattatatttccgatggaacccagtaccagtatgaggaagaaggcgccgatgaaccggatgcagccgtattcagcaaggacgatatcattctggagggcagcgggacgctgacggtcacaggaaattacggttgtgggatccgaagcaaggacgatctgacagtgaagtcgggaacgtacgtgattgacgcggttcaggacgccatgaagggaaaagattcagtagaaatagaaggaggcacgtttaccttaaatgctggggaagacggcattcaggccagcaatgacgaggaagaggacaagggatatgtgaagatttctgatggaacgttttccattacggcggccgccaagggaattaaggcggagacgctcctggaggtaacaggaggtaccattgacattgattcggaggatgacgcagtccactgcaatggtgacgtgaacattaccggaggaacgtttacgattgctactggagacgatggaatccatgcggataatcaggtggtgatcgacgatggaacaattacgattatagagagttatgaggggatcgaagggctgacgattgatatcaatggcggcgtaatcgacgttacctcggaagatgacggtttaaacgcggccggtggaaatgacggctccggtaatctggagtccggcatggaaggaaggccgggaggcccaggcggcacttttggttcaacggaaggcgcctatatcaaaattaccggaggtgagataaaggtcagcgcctctggagacggcattgactcgaacggtgatttctatatggaaggcggcacagtgatcgtagagggcccgacagacaatggaaacgggacgctggattacgatggaaccggaacgatcagcggaggaacatttatgggaaccggcagttccgggatgctgcagtcattttccagtgactccactcaaaatgtgattgtcgtgtattttgctgatacgaaaacagccggcacggagtggacgcttacgagcggtgatgaaacggtaatgctgtcagggaatccggataaggagtattcttctctgattataagttccccggaattaaaggacggggagacgtatcagctggctgcgggagaagaatctatggaaatcactgtctcgggaatcattacccagtccggcatacggtccggaatggagggcggaccgggatctggaatggagggtggaccgggatccggaacggacgactttaagaacaatggccctcggaatcgcggatccggtgataatgttcctgagaaaggcggagaaagtggcataatagataatcctcagcagggaggcggcatgcgtgggaatcgcggcgctgacggcagcggaggaggggaaccgggagaagaaccgcgtccggggacgcctcagtccgacggggaacaatgggaaggtgcggaaccagctcaggaatcggctcaggacgcggagagctgaagtaataattgaaaattttaccggtgcattctcgtgatttaaatcgtgagttaaacggcagggtttgttgcggattcacttttgcagcatgtaaatatatgtgtctgtcggcacggctctaaaaaaatccattgtcagtttcctgactgtaacatagtaaatcatcttaaatagtacttgaaatagtcagacatttttctatacaaaaacagaacatacattcgaaattttattgtacaattcatgcacatatggtataattgatttatggaaaaagtatatgaaatatcagagaaaacaaaattaacatatggtcgtggatatgtatattctttacagtaccatcttatctggtgtaccaaatatcggaagaaggtattaacagatggaatcgatattcaatgtaaggagatgctgacagaactggcggaccagtattcttttcagatcctggcgatggaggttatgccggatcacattcatctgctcctggactgccgcccacagttcatgatatcagacatggtcaaaatcatgaagggaaacctggccagaaggctgttcttagaccatccggaattaaagaaacagttgtggggaggccatctctggaatccatcttactgcgcagtgactgtcagtgacagaagccatgaacaggtgaaacactatattgattcccaaaaagaacggtaacagggggaaagaggatgaacagagagcaggaacagcttttgacggatacatttggaagctgccggtttgtttataatcattatcttgccctgcagtcggagaactatcagcagggcaaggcatacaggaataagactgcctgcaataacgactgcaaccgaattctcaaacaggagcagccatggctaaaacaagtggataaatttgccctgacgaatgccatctatgcgctggattcggcgtaccagagatttttcaggagacagggcggttatcccagattcaagagcaggcatcacagccgtatgtcctacactacgaactatacgaatggaaatattgccgtactggctggtgagatcaagctgccaaagcttgggaaggtgggggcagttgtgcacagaagggcaccggaagactggcgtctgaaacaggccacggtatcaagggaaagtgacggcagttattatgtgtcagtcctttacgagtatgaggctgcgattatgccgcaggcagttaatccagagcaggtgattggactggactataaatcggacggattgtatatggactcagatggcaggtgctgtggcatgcctcattattatagaaagaaccagaagaagctgacaaaggcccagaggaagctgaaagcgaagcagctgcagtcagtaaattaccggaaacagcagaagaaaattgcccgtattgcaaaaaaggcagccaatcagagaaaagattatttgcacaaaaaatcaactgagatagccaatcggtacgatttagtgtgtgtggaagacttaagcttgagggcgctggcaaacagagggttcgggaacggaaaagcgaccatggataacgggtatggatcatttcttacgatgctaaagtacaaactggaggagagaggaaagcgtctgatccgcatcgaaaagtggtatgcatcctcgaagacctgtagccgttgcggtgcggtcaagatgatgccgttatcggtccgccgttatgagtgtaactgtggaatgagcatggacagagatttaaatgctgcgatcaatatcagaaacagagggtatgagatatatctaaaggcagcatagaagtaatcataacctgtagggccgggacggtccgaacagaataatcaacgcctgtggagctggcataagacctgttagatagaagggcaattggcgctgaaacaggaagctcgtgtatttatacatgagtatgttcactgatataggattccaattctcactttttatggtaaaatagccatagagaatggaaattggaggtttgacagactttggaaaagaaaatttggctggacaaattaagggcagaagacagggatacggtattttccatgacttccgacccggagattgtaaaatatatgcgttttgatacccatgagaagccggaggaggcagaagaactcatccggcattatacggaaggaggaaattacggctttctcatacgaattgcagacagcaaagaaccggtaggagtcgccgccctgaaacaggatgaggagaactgcggagagtattcggtgtctctattcagttttcagagattctggaacaagggatacaataccgccgcggtggaactgctgaagacatttgcacaggaacagggaatcagaggcctgaaagcttatgtggtggaagaaaattacggttcacgaaaggtaatggagaaatgcggatttcagatacaggagatccttcattttgatgattttccctctggattatacgtttacgctctgccaatggaatcaagcgttgtacaagatatagaaaggataataccatgaaactgtttggaaagaaggctcagcctaaaaaggaagaaccaaagacgcaggaagcagtcctaacactgtatgcctgcagaaaagacgggaaggccgtgccggatattgcatgccgtctgtttgctgatgtgatggacaggatcttttatacggacgaagatgaatttcagattcgttttaaggatggcaccgcagcggttttccacctggtaacggacgccgaggagacgaaggtgcagtccaatggaatggccaatttcttttcccaggcccctcttgagaatgaggaggtgaaggaagcggccctctgccagatgcgtctgtttaattgtatcataggaatccggttcgaaattgacggggacagcgacaggacaaacggtatcatacactccatttatggcatggcggaagagctcagcgcctttgtgctgtatcccaatatgtatctgtatcactgggatggccgcctgctgctgtcgattgacggaaagagtgattttgaagagttttatccgcaggccagcaccacgattctggatcgtgaggtgaatgaggaagaggcagacagagaacggaaaatgcgttccatcgccattttaaaggagaaggggattccctttcttgagcatttaaaggcgtcggtgttcgaatcggaatgtaaaattccggacaaggaagtgatcattcatcgccttgcctgtatttttaccgcttgtgtccagtctgagatttataccagcggccagtttgaaaactgcagggaaatggcggcggaagagatcgcacagatggaggaacgctatcagatctcggattggctctcaccggaagagcgggactatctcgaaaatccggacaaggatccggcgctccataaccggtttggctggcgatacgagtgctgctctgtacttttgtgggcactgtccatgatggagttgaaggaaccgacagaaatttgcgatgcctctgagcttggggctgtcatgtggaaccatacctttgacagcctgatggaagcagcggtgcttcgcagcagggacgagattctcggcatgcaggatctggtgctgcggtatgactgggcctgcgtcgatgcgagagtccaccacaaggaggttccgatgctgtgcagtgatattgttttcgaatggcattatgcgctcaactggctggtgcaggccgatggaatcgcagactgggaccgggtgacaacgacgacgtaggagtggagaggaattcacggatacagctgttcgactgcgaataccgcgtgttatcggcagctggtggattttccttgaaatatgaaaagaaagaggacgggacacagaccgctttccacgcaaatttatttcacatatctttttctctcacatagatccttcggcagtggccgcattcgatttttgcatccggtaccactgccgtagattttttacttccccggccgtaaggacaatcttccatttcccatcatccgcagtttcgataagcccggtccggtatcgcccgttcccggaaaatttccctaattcctttataaaatgaatgtgaaatgcataggccctgttaggaatgataaaccaatcgctgtctgcataaataacatccagcctgtggattttcatctgctcaaaacactcattaaaactgacttccaaatagagttcctcccgctgcagccaggataaacgatgcaagatagaaacaaaataacaaatatcaggaggaacctgtctttccgcagctgagtgtttgatcagtcgttcagattaattaccgcccccacagggcaggtctcctgacacaacccgcaccggagacaatggtctcccgcaatctgataaggctcccccggcgtgatgcattgttgcggacatgcctccgcgcaccgcccgcatccgatacatgcgtcagtgatggaaaatccgctcacttcctcatccgcccctccgtaggagaagctttcccggttgattggatagtgaagcagatcaaaccattccccgctgcccgcataaatcagaaatgcatcaagtatataacggctgtcacccggatagacctcattcatgcccggattctggagaaatacctcgtccacccatttcttatctgcaaggcgcaggcgtcccgtgaatttcagcgactggcattccgggcacatggcgcttaaggcaatctcaccgctggcagccagctgcttataaaaaggcttgccttttgaggttacgatgtacattccgtcatcattggcgatcatgatattgatgatccggctctgcggatgccccccggcgtccaccgttgcggcggatgcgatcttgacctgccgaaacatagttacatacttctttgctttttcgttcatggaaaacacctcctgatgatgtaagcttactccttttgaacaggattgtaaatggcagacgaccgaaatgacccgtttggcgtccatctgcctttttctcatttgcaacccgttttattctgtgatatgataaaaagatacgattaagtaaacgaggtggcagcggatgaaagagaactgtggtatcgtcatcctctccggcggctccggccgccgcatggggtacgtcaataaggccgatctggactatcacggaaggagctttgccgggcagattatggaggagctgtcaggcctggggctgccatttttcctgtccacgggaatttacgggaatccaaccgaaattcctgataactgcactgcaattttggatattccggtcgatggacaacagggacacatcggtcccatgggcggcatccgctcctgctttttagagacggatgcggacggccttctgtttgtgccgtgcgacatgcctctgatccgggctgagatgggacgccgcctgatggaacggtggacgccggaatacgatgcggtgatctggaagacgcgcgatggccgggtccagccgctttgtggtttttactccagaacgtgtctgactgcgcttgacggatgcatcggagaaggaaactaccgcatgatggaattcctctcccgaatctcgtgcctcgttctggaaaccggccgggaacacctcccggaccgctggtttttaaacgtcaacgaccgtgatgcctacggaagactggaacggacagtctgtcccgtgctggcggtgagcggaagcaagaatacaggaaagacaacgcttctcgagcggctggtttcggcgctggcttccaggggaatccgtgctgcggtaatcaaacacgatggtcacgagtttgaggcggatgtgccgggaacggacagctttcgcatgaagcaggccggcgcgtatggcacggtggtgtactccggcagtaagttttccatggtaaaggaacagccgggtttacaggcagacgccttcttttccttctttccggaggcggatttaattttactggaggggcagaagcagtcggattatccaaagatcgaagtgctgcggcaggaggtctcgagaaagcccgtctgtgaccgttcgaccgtgctggcctatgtgacagacggaggatgggaaccggatatggatgaatctgcggccaggacagaaacgccagaacattgcaaagtaccagaaacgatcgcttcaaacaatctggatgctatattagaagtaatcattcattttctcgactccgcagacccggataacagcggcagccccaaagccgcaaaagcccatcacaacagcggaggacatgccgtatgatcatggatgaagcatttgaaatatccaatattttgagatgtgccagcccggccagccggacggagatcgcttccttcgcttatatgaagcggtatgagaaggggcagcacgtgttctacgaccgggaagatctgacctgcttctatatccttctggagggaatggtttcgctctataagctgaacactctgggggaaaagaaagtgatattcgtctacggcccgggaaaccttctgaatgaagtcctgttcgaggatattccggcttccatcaactgcgaggtccgggaggactcccgtgttctcgtccttccgaaggacaggctgtggcatgtgatggcgcgggatggcgagctgacaaaggccgcctttaattccatggccataagaatccgccgcctgtaccgccagatgaagaacaccaccaacgcgctgaagggagaaaaacgcctcgccgccaagctctacatgctggccagggattacgggaaggagacagagagagggatctccatcgagatgcagttaagcatcacctatctttccgaaatgctgggctccaagcgggaaacggtatcgaggcaggtgaagaaactctgtgactcgggcctgatccttatggaaaagaatcatttctggattcccaacctggagaatttgagcaattattttaaacagccgtgatgaaaatcacggcgttttttgtacatttctgctatagttaaaatattaacgaaaaaagaagaatcgatgcatggcgctgacaggctgtcacaacggctatgcagcgggatcaatgattgacgggaaggaaggaacgcatgaaaaaagtacaatcaacctgcaactactgtgccctggactgtaacctggatttttacgtggaggacgagaagatcgtcagggtgcttccgacaaaggggtacccggtcaacgacggcttctgctgcatcaagggactgtccctggataaacagcagactgtggtgaagacctcgccgcttccgaagatccggcaggcggacggttccatgaaggaagtttcctgggacgagggatttcagtatgtggcggatcagttacaggagcttcaggcaaaatacggccgggaaagcgtggcgggcatcagcaccggccagctgaccatggaggaatttgccattttcggccacgtcatgagaaattacttaaagaccaatgtggacggcaatacccgtctctgcatggcgaccgcggtcgtggcccacaagcagagctatggcttcgatgccccgggatacacacttaaggatctggagctttccgatacgattatcttcatcggggccaatccggtcgttgcccatcccatcctctggaaacgggtgcgccagaatcccgataaaaaggtgattgtcatcgacccgagaaaatcggagacagccatgaacgcagattactggtacccggtaaaatgcaggggagacttatatcttctctatacgctggccaacgttctcatcgaaaaaggctggatcgatcagaactacatcgaggcacacacggaaggctacggggaattcaaagaatttgtgaaaccatttaccctggaccaggctcaggagaccgcgggactttccccggagcagattctggagctggcgcagctgattcacgaaggaaagcgggtctccttctggtggaccatgggcgtgaaccagggctatgaggcggtccgcaccgcacaggccatcatcaatctggcgctgatgacaggcaatatcggccgtccgggaaccggggccaattccatcacgggccagtgcaacgccatgggctccaggtcctacagcaatacggcggttctctacgccggcggtgatttcacgaatccggccagacgggctaaggtggcggaagcgcttggtgtggacgagagtgtgctggctgagaagccgacggcgacctataaccagatcatcgagggcatcaatgaaggacggatcaaggggctgtggattctctgcaccaatccgcgccacagctggaccaacaacgagacatttgcaagcgcggtgaagaagctggagctgtttgtggttcaggatatctacgacaccatcgagagcgccgaggagtgcacggtcttcttccccgtagttccgggaatcaagaaggaaggcacctatatcaatctggagcgccgcctttccgccatgcgcccctgccttgcgaagaaggagaatgagatcacggactacgaagccatatttggcgtgggtaaggcgctgggaatgggcggtctgctgaagggctgggagacgccgaaggactgtttcgaactgatgaagaagtgttccaaaggaatgccgggcgacattaccggcgtcacatgggagatgctggagaattccaacggagtccagtggccgtttcgggagggagaggcgctggaggacgatgaacgacgcctgtatgaggacggcaatttcttcactcccagcaggaaagcccagttcaaatttgaggcgcccatggaaaatcctctgccgctcacggaggagtatccgtacctgttcaacaccggaagaggctcggtcggccagtggcatacccagtcgagaaccagtgaggttcagttcatcggcgacgtatcggccagggaagcgtatctctttatgaatcccgggacggccgccgcgtatggtctggaggaaaatgaccgcatcctggtccactccgtcaacggagaaaaggccggttttcaggtgcggatctcggatcaggtgcgggaaaaagagctgtacgccccgatccactatattgagtgcaataagctgacgccttccgtctacgacccgtattcgaaggagccatcctacaaggcgacgccagtctggtttgagaaaatggaaggaggtaacgcggatgtaccggataaaaattgacagaagccgctgcatcggctgtctgacgtgtgtgacagcctgtgtcgtcagccatgagagctgcgatgccagaaaccgggtggtgatcgacagcgagtcaaaatgcgcacccattttctgccgccactgcgaaaagccggaatgtgtatacacctgtatgacgggagccatgcacaagaatcccgataccgggtttgtggaatacgataaggaaaaatgcgccagctgttacatgtgcatcatggcctgtccctacggcgtgctgaagagcgaccgggtcgagcataaggaaattatgaaatgcaacatgtgtgtccaccgtacccaggatggttcccccgcgccgatgtgtgtggaaatctgtcccatgggagcgattactctggaggaggtgaagggatgagatacgtggtattaggcgcttccgcagccggagtcaacggcgtgcggcagcttagaaaacactgtccggaggcggagatcgtgctggtatcaaaggatgacgccgtttattccagatgcattcttcaccattatctgggaggaatcaggacgaaggaggagctttgcttcgcagagtccgattttgagacaaagtaccgggtggactggagaaagggcgttgtctgttctgcgcttcgggaagcagaaaaaaaggtggttctgtccgacggaacagagctttcctacgaccgtcttttaattgcgaccggttcccataccttccttccgcctgtagaaggcttgagagaggcaaagggcgtctttggatttcataatttagacgaggtggagcagattcgaaacgaggcggcgaaggcagagcacatcgttgtcatgggcggcggcctggtaggcatcgacgcagcggtgggatttctccatagcggcagacgggtgacgctggtagagatggaggaccatatactggcgaagcagctggaccgccgcagtgcgaaaacgtacgaggaggccatggagaaagaaggcatccagttttatctgggccggggcgtaaaggaagtgcgcatgggagacggcggagaagtcacttccctgctgctgaccgatgggacagaaatcccctgtgacatggttgtggtcaccgccggcgtgcgtcccaacgtcgaatttctaaaggataccggagtggaaatggaccggttcggactggtgatcgaccaccacggcaagaccagtgtgccggacatttacggcgcgggcgacgtgacggggcgttcccccatctggccggctgcggtgaagcagggcatgaccgcagcggataacatggcaggcgttcagacctccatggaggacttctttgcaagcaaatccacgatgaatttcctgggaattcccaccatgtccctgggagttccggagataccggatgagacgtataccgtagtcgtggaggacaacggagagcagtaccggaaaatcattcataaaaatgggaaaatatacggcgcaattcttcagggagacttgtcctacggcggcgtactgacccagctgattgccaaaagaattgatgtgtcacgggtaaagaaaccgctgtttgagatcgactattccgatttcttccatacaaaggaaaactttgaattctattatgaggagacgtaatctatgaaagaacgtttgaaaaatatgccgattccggttgtagccaccatgctgggcgccgccaccttaagcaacatctatcagggactcggatacgactggatccgccacgtgaccatgtgggcctccaccgttgtgcttctgttttacattgcaaagattgtcctttatccttccatagtaaaaggagagtataaaaatacggtcccggccagtctctatgcaggtatcaccatggttaccatgattctgtgcagctactataaggactggtttcccggtgcggccagagtggttttaatcgccgctgtctgtatccacgcggttcacatcgccgtgttcctgttcaacaatgtcttccatggcgtgaagctggataccttcgttccaagctggtttgtcacctttaacggaatcatggtttccacggtggtcggagccgccatgcttccgccagttatggcgaaagcggtattaatctggggactctgtatctatacggtaactatcccgtttatgatctggagactggcggcgaaggaagtgaaaccggccgtctggcatacccaggccatcgtgctggccccctgcagcctctgtcttgccagctatttgaatctggctgcggagccgagtatgatcctggtgagcgtccttttcctctgcgtatttttatccctggtgttcattatcgtgaagcttccgtccttctttgccgtgccatttgcgccgggatttgcgggactcacgttccccatggcaatcggtatcgtagcctccaataaggcggccgcgttcttcacgggagcgggccaggagactctgggctatgtggtaaaacagatcgccggagtgcagatttacttaacgacggccatcatcgggatggtgctgttcggattcatgaaattgctctgctcccctgcgaagaagcaggtgtaacaggatttgaggcgcgccgggaagcgcgcctctttcgtcagatctaagggaaaacaaaaagaaatcgaatgacaggatgggaagagagatggataccaggaaaacgggaagcgaaggagaagagcgggtgacattggaacgggcagtccggctgcttttggatcactgcagtatcatagcggagaccgaacggtgttcggtgctcgactgtacagggagaattctggcggatgacgtgtatgcaaagggggaccagccgccctttgaccgttcgccggtagatggctatgcctgccgaagctgcgatatcacggatgcatcaagcgaaaatccggtttatttagaggtagtggaggagatcgacgccggcagctggcccacgcgcgccgtaggctccggccaggccgcccgtattatgacgggcgctccgattcctgcgggtgcggactgctgtatttatcaggaaaagaccgattacggggagacgtgcgtggcggtctttcagggctgtcagcggcatggcaattactgctttcgcggtgaagatattcaggcgggcactgcggtccttaagaggggcacacgcctgacctatgtggaagcgggaattctggccgggctggggctttgcgaggtaacggtttaccggaagatccgggcggctgtgctggcctccggcgatgaactgacggagccgggccagcccttgcagccggggaaaatatacgacagcaacttatatttcctggctgtccgtttaagagagctggggatcgaggtccctgtctgccgccgtgtcccggacagcgaggctgagatggcagaagcgcttggcgatgcgtgccaaaaagcggatctggtcataacgacaggcggtgtgtctgtcggaaagcgggatatcatgcaccaggccctcgccatggctggggccagaaggctgttctggaaaatcctcatgaagccgggaatgcccaccatcggctccgtattaaacggaactccggtcatcagcctttccggaaatccctttggagcactggcagactttgaactcctgtgccggcctgcgtttgaatccatgacgggggagtccttctatgccccccggatgaggaaagccatcctatcccggggattcttaaaatccagcccatcccgccgttttttaaggggccgtttcgagaacggggaggtctggattcccgaggtcaaaaaacacgcttccgggatcctcagttccatggcgggctgtaactgtctggtggacatttcagcgggaacggagcggatagaggccggagaaagtgtgacgatctgcgatctttcccttgacagataagggagactggcgggaaatggaaaaaagtatacctgttcagcaagataatgcttgtaaaattcctccgtatcggataatattatctggtatttatacatgggaatgcataataataaatcgaaggctcatcagaaatcgggttaggccttcgtaagatactcaggaggaaagtaatgaattacggtattttaagcctgcttccgcccattatcgcggtcatactggcaattaagagcaagaatgtaatcctgtcccttttttgcggcggttttgcaggcgtgatgattttcagccacgggaatccgtttctggctgtgaaatcgatgattggagattatttattcgtacagctgacggacagctataacgcgggagtgattgtcctgatcatctttatcggcggcttcatcaagctgatggagaaatcgggaggtgcccaggcattcagccagagtgtctaccgctacgtgaatacgaagctgaaggcccagctctgcgcctgggcgggcggcatcgtaatctttttctcagatctgggcacaccgcttctggtagggccggtgtttcgccccctgtttgacaaactgaagatttccagagaaaagcttgcctggattctggattcgacctcctcgccggtagccattctgattccgtttatcggatggggcgtctatattatggggctgatccagtccgaatttgacaatctgggagtaatggattccgactatacgacgtttgttcaggcgattccatttcagatttacgcaattctggcaattatcatgattccgctggttgcctttacgaagctggatttttcccagatgaagaaggcggaactccgtgccgggaagtccaacgagatgttttccttcatgcaggaggacgaggagaagggcagcgcggaaacgggatattcccggaagaacgcaaaaccggttatggtggttctgccgatacttgtggtgtttgtgacgctgttcggcacgctggccccggccggtttcccgtttaagaaggtggacggcaatgagttccgggttgccctgactatgggatacttcttcggtgcaattgtgctgatggcatttatctgtatttttaaggttatgcggtttaaggataccttcaaggtgtatgtggaaggcatgaagggtatgacggatgtagcggtcaccctgattctggcctggtctctggggaaaatgatcagtggtcttggaaccgcggaatttatcgtggaattcctccaggccatgcgcttttccgcggctctggtaccagcctgcatcttcctgtttggcgcgtttgtgtcattctccacagggagctcctggggaacctttgcgatcatgatgccgctggcgattcccatggcacaggcgttcggtataccgtttgccatcgcggtgggcgcggtcttatccggcggactgttcggcgaccactgttcccctatttcagacactacgattctctcctcaaccggcgcggagtgtgatctggtggaacacatcaggacgcagctgccgtatgcggtggtgaacggaatcatagcatttgccgcctatattatcgcgggagtgacgaagagtcctgcagcgctgctctttgcggttgccgcgctggtggcggttatgatcgtctttaaccgcctgcctgataagatgggaaaaagggcataaaaagaagctgtcagttatgccgcgcaagccgcaaaacccccgtatttccatgtataaccggaaatacgggggttttaatttatcataactaaacgtttataattccgacagaaactgatctgtttcccgccggttttttaatatgacgattctcacatcatccgcttcgctcatcatatcatagaaacgcctgcgggtttctttgtgatgagtccaaacactcttgataaaacgtatcttttccgcattcagtttttccgggcagtttcctcccatatccgtgcggcttttaccatagtttttcacgaatcgtccaaccactccgctcagacatctgatccgggaaaaatccatgaaaatgacggcgtcacagtactgcagccggagcgggattgtgcgcgaaatattaccgtcgataatccatctgggctgaaccagttccgacatcaaaagccggtcaaattcttcatcggacacaggcttccagttatcgttccaatacagtgcgtccagatggatcaaaggcaggcttaacttattcgccagcttatttgaaagggtggttttcccgcagccattgccgccgataatcagtattctttccaatcgtaaatcccccgtgatcaatcaatgattatctaacagtataaggcagcggacttccagttgtcaatggccgcggcagactgtaaaaaaataatagcattgctgtcacaccgacagatggagcacttcataaaccgttccttctacagacgagtccggttttttgccgaaaaaagaatactccttctgcacccattgttccggatcacagagcagcaccttcccggtacagccgtttccaactgcggaaaaatgcggccgcaccattttccgggacgctggaagaacctgttctgtttccagcataaaccgcgaagttaaaaattctttttcaagttccacaaaaacgggaattcccagttttatgcgctgtctcccaaacgaggacacaatattatcgtagtacccatcccatataaaatggatcattccgggactgtccttccagagatacagcggggaatattcgttgccgccttctgatccgccttgattttcccgtatcagataagccttaaacagcaaatcttcaaaaccatctgtcttcgtcccgttatgtctcacgcgctggcgtatgagattcatgtcgtaatgatccggcagcgctatttgatactgcattgcaatcataggaagctccttctttctgtatcattcagtgccgggcccggcggtgatgtttttactatttaattatacagaactgccgccgtcgtgtataatagttggtaatgatgtctggtatcattttaaatgatggaaggagctatggaaagtcaggaactcagaatattccgggaggttgcccgcgcaggctccatctcgaaggcggccggtcagctgggatacgtacagtcgaatgtgacggcaagaatcaagaaactggaggaagagttaaacgccgttctgctaatccggcacagcaaaggggtcactctgaccgcggaaggggagcgcctgttaatcgcctcagaagatatccttgaccggatcgacagagcagcggcccaaatcagggaccgcaaaacatttcggatcggagcggctcatacgctgtcgatatccagactgccgctgtggctgaccgcatttcaggaacagcttccggaaatgaatctctctgtggtcacggacagtcaggatcatctggcccaatatctggccgaaggaaaggctgactgtgcctttctggaggcgcagtacgtgacagaggagatggagacactggcatcctttcaggaaacactctgtatcatcgccccattcggctgcgcggaacgggagatgattcagatgccggccatagtaaataaaatagctgcgtgcccttaccgcgcccgtctgcttgcatggtttcaatcccatggtgtgcctgctccacggatcatcgagatggacacggtcgaggccatactccgctccgtcgagctgggaatggggatttcccttcttcccgccagcgtcctgtcagaacggcaaaatattgcggtatcaggtgaactaaaaatggatcctgtccggatttttctgtccgtctgcaaaggcagttccggcagggcctccgaaattctccgggaaattatcataaatggggcgaaatcataaaataaaaaatattttctaataaataatcacgacatacagatgtcctgtttatttgctataatagagaaaaagcagcgaaaagaaggcttgaaggagaagggtatgacagaatcaaagaaaaaggcagtattaaagagcaggatcgagcaggtatgggaggttgtgacagatctaagcgactgcagctggcgcagtgatcttcagagaatcgatgtactggagcctgggaaaacgtttgtggaatacacgaaggagggctttccgaccacgtttgtgatcacccggttcgagccgccgtaccggtatgaatttaccatggacaacgccaatatgacaggtacgtggaccggtctgttccgccagacggacgaaggctgtgaagcggattttacagagcgggtggacgtgaagaagtggattatgaagccgtttgtaccaggttacctaaagaagcagcaggagcagtattttaatgatctgaaggcggcgctgggcgagtgagcgcaattgggaagattgacctatcatgagtaacaggaggcatttatgaaaattgatcgactaatcggaatcctgtccatccttttgcagcaggaaaaggtgacggcgccataccttgccgggaaatttgaagtatcacggcgaacgatcaaccgggatatcgaagacatctgcaaagcaggcattccgctcgtaaccacacaggggcccaatggagggatttccatcatggaggggtaccggatcgaccggactgtactgacttcatcggagatgcagtcgattttaaccggacttcgcagcctggacagcgtatccggtaccaacaaataccagcagcttatggacaagctggccatggggaattcttcgattctgacctcaaacagtcatatcctgattgatttatcgtcctggtacaaatcctgtcttgcgccgaagatcgaactgattcaggcggcgatcggcgcaagagaatacatcacctttgcgtactttggtccttccggcgagagcagaaggaagctggagccgtatcttctggtctttcagtggtcctcctggtatgtgtggggatactgtaccgatcgtgaggattatcggctgttcaagttaaaccggatgctggagctgaaggcgctggatgagcgctttgaggagcggaaggttcctgcgtatgatatgtcaccggacaaggcatttccgccgcggatttccgtcacagcggtctgcgaggcagatatgaagtggcggctgattgaggagagcgggctggagagctttcaggagagggaagacggaaaactggtattcagctcctgcttttccgattccggaagcgtatttagctggctgctcagcatgggagaccgtgtggaactggtggaaccggaagaactccgggtgaaatttgccgccatggcagagaaaatttgtcgtatttaccgttaatgatgacatacagttgtcgtgattaaagtgttatcctgtaagcgtacatgagaaaaccacagaagtggtggaaaagaggacaaccggatgaattacgaaatcgtgacactgcctgagaagaaggcggcaggaataacagcaaggacgaataaccatgcgcctgatatgggaagcgtcataggcgggctgtgggaaagtttttatgcgaaaggggtttacgacagtatccccgcagacagaagaggctgcgtcctcggaatttattcagactacgagagcgatgagaacggcgattatgatatgacggcagcctgtgaggtggcggatgatgccgggcttccggagaacttaaggatccgcacgatcccggcaggcagatatgcgaagtttgtagtcaggggagatgtgcagcaggccctggttcagttctggatggaactgtggagtatgaacttgaatcgtacgtttcaggctgattttgaagagtatcacgggatgtccggcgaagaggcggagatccatgtctatataggattgaaagaggattgaacaacaggagagggaatgatgagtatggaattcaaacgggttactttggagaatatcgaagaagagcacatctgctgtgccatatcggataaaaagggagagacctgcgtggcctccaagaaggcgtggctgaaggaacggctgaaagagggacttgtgttcgaaaaactggatgtgcgcggaaaggtatttatcgagtacctgccggcggagtacgcctgggtgcctgtcgatgcagatggatactactatatcgattgtctgtgggtttccggccagtataaaggacagggctatagcagccagctgctggagcactgtatcgctgaggccagggcgaacgggaagaaggggcttgttatactttcctctaagaagaagatgccgtttctgtcggatggctcctacttaaagcataaaggatttgtgacagccgatactgccgcgccgtactttgagcttatggcactcccatttgaagacgggacacccctgccgcgctttttagagtgtgcaaagaccggtgagaccgatgaaaagggatgggttctgtactacacagcgcaatgtccccacacgtcgaaatacgttccgattctggcggaatacgccaggactcagggcattgagatcaagacagtaaagctggaatcccgggaagctgcaaggcgcgcgccaagcccatttacaacatactccttattctatgacgggaaatttgtgacgaacgagattttatcagagaaaagcttcgagaaatacaggaagaaagtgtaacgtgctgcgcaaaacgcagatcaattcacactttccctggtctgagaaaagaaaaaggagaccgatgatatgtctgatattgcagcagattacgagcttcaggcagacaggctgcgcagattgctaaaggcgaaaaagacctttgaaccggctatggaattggcacttgaccttcatgcggtcacacatacgggggtggtttcgggaagcagcagccccacgttttgcgatcatgtgctggagggcctggcagatgaggattacagtgtgatgccgactgagaaagatgaaaccatagcctggcatttatggcatatagcccgaatcgaagatctggtcagcaatcttctgattgccagacagtctcagattttcgatgatgattggatggatcgtatgaatgtgactgtcaaagacaccggtaatgttatgagcgacagcgaaataatcagtttcagccggcacgtcaagaaacaggagctgatcaattaccgcaatgcggtaggctgtcagacctgtgccgtgatcaaatcacttaccccgagcgacttaaaacggaaacccgagtccgaatatttggaccggctggtcagcgagggtggtttactggaccggaaggggtctgtctggctgaaggatttttgggggagatatacggtgacaggacttttgctgctgcctttgacacgccatcatatgatgcacctgccggacagcgctgcgatcaaagaatttataaaaagcggtgccgtaccttttctgaaaggataattttctccataaaaaagcaaaaaaaatgtggactccggcgatcctaaacggaaatcgctttttccacatctatatcataccacaaaaatctctttttttcaagacttgtaatgaaagtctgaaaggcgtagaatcagtacttaccaaatacggggaggaaaagagatgcaggagaattggtatgaactgatggaaacagtacaacggaagcaggaactggaaagagtgctggcttgcaacgagaagacaaagtccttcggactcacactcactgaggaagatgctgggagactgatggcaggccggcgtgattccctgaggacgcagatgcgggtcgaattcggaaagggggtattgccggagatcatagagactttctgtgattctccctatttgcagcaggaaaactatgctgatgtgattgcggagctgcaggaaatcttctatctctataagaacgaatcagaagacaacttaacggatgaggaactgctgacatttatgaaagaacagtttgacggtgtctgttacggttccgtcgcctatctggaggaaacgtgcctggaacgttttgcgagggcgattcgcgccggataccgggattacgtggaggacggtggaaagggagagtacgagaaattctcacaggaagcacgttgggacagggatctctttttggagacactctttgacctgctcagttaggaggcggacatggattatacgatggaagaactgctgcctgttgtcggaaaacttacggaaaagtataccagtctttccagcacctccgtcacctatgagacggcacagcagctgatgggagcggtgttttactgcctgcgtgaagcagaatatgaagcggtgaagacaggaaaaaacagcgtagccaccgcctcagacacggatttatggaggttttaccagcaggggtatgaggtggttctggagaagaccgccagggccaagaaggtctacgatcagatcattgcgaattttcgttccttcggtaactgctgttatgaggatacggtcatcaaagggatgccggaattctttgtccattacgatgccagattccggccccaggatcatctgctcactctggattacccgattttacggcctgtagggaagcgaaagggaatagacgccatctacttttatttatcctgtgttctcctggaacagagattcttaagcaagtttccggaagcgtacgggaaggcggtcctggaacactaccatggggattacgaggatctaattctgaatgtggcttctgtcattatgcggaatctggtgattcatatgatgatggggaaaaagctgtccggggatacggtgacggcagacgatacggagcggttttgcagccatgtgaagaactgtgaaccacagaaactcgaggaagccataggtcagctgatggagcagctggcaggcggcccggagggggacagagccctgttttcctatctgtcctgcgacaggaaggattttgcagcagaacttaggaacgcagcggagtatggatgcatggaccgtatgattgtttattagaattacgcagagaacccattttaagcatagttatggcactataataacattataataacacaggagtctgcagttcaggaaaaggaggcggtttatattgaagatgcctgaagcaatcggcagtcagctgtttgcaccatgcggaatgaactgtatggtgtgttttacacactgcagtactaagaaggcctgcggaggctgcctgggaaccgaagagagcaagcccggacactgccggacctgtctgcgaaagaactgtgcagctgaaagagagctatcctactgctatgaatgcagcgattttccatgcagaaggatccgggatctggacagaagctatcgcaaacgctatggcgtcagcctcatagaacagtccctgtttgtgaaggaaaacggcatagaattatttctggaaaatgagcggaaacgctatacctgtgcggcctgcggaggtgtaatctctctccacgaccatcgatgcagtgaatgcgggcgggtaacttctggataattatttatgatgaagaaagcggtttaaaagaataacaaaatatacataatgcacaaaaaaataaagatttattgataaaaaggcgaatagactaaaaaacttttagcgtatataataaattttgtgattaaatattggtgctattcattatgtatatcctgagaattggctcagagtctctaccaactaccgtaaagagttgactacatagtttatgtagttgactctttttttggtaatttcatgtttgttggtggaagggagcgacaatcgtaaacctttaaaatatagactacaggatagcaaagcaggcagtcttaacaggcagtttatttaaaggaagatggaggacatattattggaacgaaaaacaggattcgcagacaggttttttgggatatcccagagtcattcaagcgttaaaacggaagtacttgcaggaatcacaacatttatcacaatagcctatatccttattctgaacccacagattttatccgacccatacttgattatgggagatgcagcgatggcgcagaagattgccaacggcgtctttatcggtacctgtatcggagcgtttattggtacgatcctttgtgcattgtatgcaagggttccgtttgctcaggcgccgggcatgggattaaatgcattttttgcatacaccgtggtgctgggaatgggatatacgtatggacaggcgctggttatcgtatttatatccggtatttttttcatcgttattaccgcaatcggtctgcgagaggcgataatcagatcaattcccgacgcggttaaaacagcgattacccctggtatcggtctgtttattacgattatcggactgaagaatgcaggaatcgtcatttccaatccggccacactcgtaagcctggttgacttttccaaatggagaagcggcgcggatatggttttgatcaatggcgcgctggtggcactggttggtctggtcatcatgggaattctgcatgcgagaaaggtaaaaggttccattcttctgggaattatagcggcaaccctgattggaatcccgcttggtattacgcatctttcaaatttagatatgaatcttggagtgaaattccaggatttcgcggaagtatcatttttaaagatggattttgccggcctgtttgccggaacaaactttgtggaaactctgtttacggtaacgatgctggtcatcagcttctccctggtcaacatgtttgactccattgggacacttctcggagcggctaaacagtcggggatgattgatgaaaacggcgaagtaatccggatgaagcaggccttaatgtcagatgcggtctcgacattggcaggcgcaatggtaggaacctccaccgttaccactgtggtggaatccagcgctggtatcgcggagggcggaagaacgggtatgacgagtcttgtaaccgctctgatgttcctgggagccattctctttgcaccgattgtcagcattgttccggcggcggccactgccccggcactgattttcgtggggattctgatgctcggtaacatcagagatgtggatttcagcgacatgagcaatgcactgccggccttctgtacaatcgtatttatgccatttacatattcgatcgccaatggtgtcgcatttggactgattacctactgtctgatgaatctcatgacaggcagaaggcgggaagtgaaggctttgacgctgatgatttcgtttgtgtttgttgtaagatatgcgtttatgaccttgggatagagtgggagaccggtttaaaagagctcttgaaaagatatgataaagtgtggtaaaatcgaaacacaaagataaaaacacagcccggtaggtagtccgggcgcagcggacaatattcgtgaaaccgctgtcagtaaccttcctccttaggtcgtccgttctttgtctattttgaatcatataaggaggatatcattatggacaaagtatcgctgacctttcgggtattttttgaggacccgttctggatcggagtcgtggaacggatttcggacggaacgatggaagtatgcaagatcaccttcggtatagagccgaaggattacgaggtatatgactggctccttaagaattattatcggctgcgattcagtccggccgtgaaagctgaggcaaaaaaagaacataccaacccgaagcgcaggcagcgggaggccaggatgcagacggcggtctccggcatcggaacgaagtcgcagcaggccttaagcctgcagcatgagcagctgaaggaggaacggaagatccggacccgcgagcagaaagaagcggaaaaggaagccagattcgaattaaaacagcagaaacggaaggagaagcacaggggcagatgattctgcctcctgtgtttttttatatttcatgataacaggcaataccgctatggaaacacccaggtcctccgtataatcgaatcccctgtttgaagacttttcgttactcgtttcatattatgtttcatattatattgtaaagatcaaaatcgggtaaaagaatatgaaagaaacaggctatcggcgggacgcggcactggaatatgcaaagaaatgggccatgggcagaaatccacggtatttggactttgagcattttggaggagactgcacgaatttcgcctcacagtgcatttacgcggggagcggggtcatgaactatacgccggtgatgggctggtattataacagcagcactgacaggacgccgagctggacgggagtgcagtatctttacaattttctcgtaaataacaaatcggttggtccgtacgcggcagaaaccggtcaggacggtgtacagccgggagatcttgtacagctgggcaatgccaacggtttttatcacagtccggtaatcgtcgcagtcacggacggccgcatttacgtggcggcgcacagctttgacgcttatatgcgccctcttgattcctatttatacgtgaaatcccgctttctgcacatacagggagtacgcagttggtagataccgaaagcagaaaacaggcaaaagctattgactattgggttaccagatagtttatgataggaaaaggcaaagccaaaacaaagaaagaaggggaatcatgtatatccatgttgagccggtaaatgacaagaaccgtgaggcggtactggctctcaaaattcacgaaacacagaagggatttgtggaaagtcccgaacaatgcttaaaggaggcagcggaagagaaatgctggcgtccggtaggcatctatgacggagaacagctggtaggcttctccatgtacggttatttctggcagtatctgccatttggccgtgtctggctggaccggctgctgatcgaccgggattatcagggccatggctatggccacatcgtactcccgatgatgatcgagaagctgagaagcgaataccacagaaagaagatttacttaagcgtagtcgaagaaaatcagggtgcaatccacctctatgagaaattcggattccaatttaacggagagaccgatgtccatggagagaaagttatggtgctgaacgaaacctgaattagttgacaaaattgtaaaaatatgatatattatctttcaataaaagggagtagcgaaccatcatccgatggattttaaatcgtcttcttggtgtttttataagcacccgtataaaatgaaatgtgcaagacttttattgtggcaggaactaccacggtaagagtctttttcttttcttcataaaggaagttccagccacgcacgaaaacttttagttgtcgtcagacaggaaggagaatcagtatggaagaagagagaagaaaacaggaagtagaagaggcgatcgccgccgcaaaccgtgtgctcatgaatctgagacaggccgaaaccgcgctatcaagtgcaggcagctggggaatctgggatatgctgggaggcggaatgtttactacctggatcaagcactccaggatcgatgatgctagaacgtctctggaggaagccagacgcagcttaagaagcctgcgcagggaactgatggatattgatataccggcagatttcaaaatcgatattggggaattccttaattttgccgactatttctttgatggattgatcatagactggatggtccaggcaaaaatcagggaggcttcggacaacgtgagtgaggccatacgccgtgtggagacgctgcggaccagacttcacgaaatgctgtgaacagaggcaattccctaaacaggcaatacatttacaggagaggagggctgagccggttcacggcctggccctcgccggatgcaggaaacaatctgatgaggtctttcacgaaaatactgtttatggtatactaatactgcattgcgctgcgcagtactgggagcacttgatgttgacttgatattgacttgatattgaaatggaggaatcagtttgaaagaacgcgagataaaatacgattttctaagggcggtggcggtgctggcgattattatggtccacgccataccggctgtctctgtcaatgataaacagtggtggtttgcagcagtcatgcagccgcttctgctcagctttgtcggaatatattttatgctcagcggtctgttccttctggattcggcgaccggagatatcacacaattttataagaaacgggtaaaagtcatcgttatcccgtttttatttttctcggttctttattatctgttctatgtcagccgcagccaggaggtcttatcctggtgggagtatccggtggaattcctgcgggattttttcagtggtacagtgcctatggcggaccatatgtggtttatgtatgtgatcatagcgctctacctctgtacgccgtttctggcccgtatgatgaaggcgatgaatgataaggaactgaaatattttattctgctcatccttggagtacagacactgaccaactatgccggcggatttggcatcggactggatcagattctcgattatatggtgtttaaaggctggctgaactactatgtcctgggatatgcgctgaagaggctgttcaaacgggaggaatttaagtggtttgcccttgctggaatcgtggggctggctctgacactgctgcaaaaaaggtttacgcctggctttgtaccgggaattcacgatctggcgcctaccatgatcgccatgtcggcggcagtgttcttactgtttgagtgctatggcaatttaaaatgcaaggctgccagaacagccgctgtctggatgagccgccacagctattcggcctatctggctcactatctgattttaaaggccgcagccgaattgctggtggatcaaaccgtggtgagacatttttacgttccgcgcattgtctgtgcgacgctgctgactgcgattctgtcctttgcggccgcatggatcttagacagtacggtgattcgatggctgcaaaatttaattaagacggatcgtggcagatgatgcaagggaaatggaccaacgaaaatgaatcaatagagatgaatcaatataaaggggagatgtacgagatgtcaggaaagaactgtgaaagctgtatgtattatacatacgacgaggactacgaatgttacgtatgtgatatggatttggacgaagatgagatgatccgctttttaaggggcgacagcggcggctgttctcattatcagtttgccgatgaatataaaatcgtccgaaagcagatgtaagacataaaaaagccccataaaagggaggagccggtatccttctgtaagaataccggcgattatgaaaaaaattttatctgatgtaaggcataagcatctttctcttatgttataagtatatccggtaaatatgaagatagtttgaccgggatgtaaaaagattatgaccagaatatgaacagaacgcgcttcatattaattcgatcttaagggacaggcagttcgatcagaaagctgcgctgccgtcatatgtaacgctcttcaaattctgaaatgggaatcggtctggaaaaaatatacccctgcaccatgtcgcatttgatcatacggaggtattcgaccatctcatctgtctcaattccctctgccactgtgtgtaccttcaactttttagacagctcgatgaggcatgcaatcacatcttttgccttttcaccagccatattgacaaagaaggaacggtccagcttgatcgtatccacatcaaattccttgagcagtcccagcgaggagaatcccgatccaaaatcgtccagggaacataaaaatccaagctgatgcatctggcggatcatttcctttactacattaatctggcggttgtcaaagaagatggattccgtcagctcaaactcgatcattcccggcggtatttcgtattcttttgcaatatctgcaaatttcttcaaaaaattatgttccaggaaatgctgtcgcgataaattaacggaaacagggatcggattttttccgcttgcgatccaggcgtgcagcgtttggcagacctgtgtaaagatatagaaatccaggctgcatatttttccgttcatctcgaacagaggtatgaaattcgagggatagatcacacccttttccggatgaatccagcgcaccagcgcctcggcgccttccgcccgattagtctccagccggatcttcggctgtaaatacactttaaaatcatgatttttaatggaactgtcaaataaatcatttagctcctgttccatcttcatgcgctcggtcaggctgttgtcgtaaaaggcgcatttttccctgtgttcggcagtctggctctggcatgccagtctggcgcggtcctgcagaagcgtgatctccagactggggtcatccaccacacaggctccctgccgaaacgtcatgtggcaggcgggcagatccgtgctgcgaaaggcgttgatttcccggatcatctcatccagacggttctgaagtctctccggttcgtgttctttcagacacaggaagaagtgatccgattccacacgggcggcaaattcatcgtccgcaggccggagctggcgttccaggacctggtataagtaggccagaatccggtttccggtcggtatacccaggcgttcgttgatgagcttaaagccattgacatttaccagcaggatggaatacgtatcgggagccatagttttggccagttccgtgtatttcagttgaaatgccgcattgttgggacctccggtaagcgggtccacaaaagccagacgttccagctgtttcctgtgaatgtggtagaaacggtataccgaaaacaggaacagggagaagagcagtatggtcagtccaatgatgacaaatgactgcaaaatatagcgctccgcgccgctggacagaaaattcgcaggtatgagcgtcagcagaaaccagtcattcacaccgagtgaattgtaggacaggatcagattttccttcgtaaccgccgtaaatttcaagatcccgttttggttgcttttcatgttttcctgcattcggtgaatttcatctatgaccttcttatccttattctccctgaaaatatcatccagccgcagaaatggctttaagtctgtgggtgaaattaccacctgtccagtgctgttgatgatgcagctgagcatctcgccgtcaaagttcttagtggaaatcatggcctgcatattctccttgcttctcacaccgatgagaacttcgtcgatctggcctttcctggatattgggaccgagtaaaaaatactttgtccccctatgtaattcgcctttacctccccctcaaaagaggcgagaacgccgtcaatctgaaagaagtctgcggaagcgatccagggaggagcggagtcgccgtcagaggaaatgatggtgccatccctgtgcagcagaatcaatgggtcaaactccaggatctgcgcttttctgtgtaaaaattccaccagttgttcttccccggtacactcctcatccagatgggaagccgtatcggatattgtgacgaggctcgtcattttattggtcagggcgtcgtggatatcgcgggcggtctgtacggttacgtcgtctaagtatttttgtgtgctttgatttaaggctatgcgcagatcagctgcatttccgattaaaattgtaaaaaccagaagaatccctacggacaggactccgatttgcaggcctttcctgaaaaagggattgtgaaaatcaggttttttctgttctcgtattttcatctatattgtctccatttataaagaacattgtgatagttatactccgttttattttaatttaccctatttgagaaatcaatataatatttgtgtacgttagcatatagtatagagagaaaatgtgatataatgaaggtggttttgtgaattatgaggcaggccagggagaagaaaaacggttctgggaagaggcattatgaaaggtagataagatggaagagaagaggacactatttgaatatttatataaaaatctcagagagcagatcatgacaggatacttaaaatatggagatccgctgccatccatgagccagctctgtgaaaattaccatgtggggatccggacggtaaaggatgttctggccgcattgaaaaaagaggggcttatccataccgaagagaggaggccctcaatcgtggcgtatcagccggactgtgaggtgcagaaggaacatgccataagatccgtgctggagcggagacatacgattctggaggtctataagacgatggagctgattatgccgcggctattcgcattttccatggtatcctgcggcggggagaaggtgagcctgagctttcggcagctaaaacaaagcagcaaaaaagagattactgtccgttggaaggcttcatcggcggcgctgcataatcttttggatgcttcggacaacctgctgtttcgggatgcgtttacgagccttgagatctgcgcacgggtcccatttttccttgaattccggaagtctccggcattttcggcttcatacagggcgtataaggatccgctgtggatgctggaggcggtcaatacaggtgatccgaaggaagtgcgccggtgctttcagacaatgtatcacgcgatcgcaggcgatgttaagcagtatatggaagaactgtcggttatggttccatttccggcggaagaggagaaaagctattattactggagcccggaaaaaggacgggaccattattacatgcagattacccgtgatttgattgataagattggagtgggaacctaccgggatgggacgtttctgccttctgaggccgcactggccgaagaatacaaagtttctgtctctacgatcaggaaagcggtggccatgctgaataaatgtggattctgccatacatacaacgttaagggaacacaggtgacgctgttcaatgacgatgcaaccgtgcagtgcatgaagaacaaggtatttaaaaatgatacgctgctttatttgagcgggcttcagtttatggctgtcgcggtctggcctgctgccatgcttactgccgaatcgatgaaagtggaagccagaggcctgctggaaaaaatagagcagaccggagcggttccgctggatctgattatgcattccatggcagagcacctttccctgagaccattacaggtgatattgcaggaggtgagcgggctgctccactggggatattactatagtttttacagcgatggttccacacaatccaatgaactgaaccggcggtgccggaaggcaatggattgtctgcttgagggggaggcagaggcatttgcccgtcagctttcgctttgctactgccatgtgctggaggtggtccgggagcacatggttcagtgcgggctttatgaagcgaaaaatctggtcacgccaaacccggaagattgggaagagactggggaataaaaaatatttaaaaagttttcagatggctgcgataaaatgtaagtctgctccgttgtaaggatgaaaaggaagaaaaaaccagttttacacgaaaggagtaaagacatgaagaaaaattttatggcggccatagcggcagcggcaacggtaactttaggaggattggggctttatctgggggctcccagccagtatctggcatttgatattaacccgagcatcgaattgaaggcgaacaggctgaatcaggtcgtttctttaaaggggacgaacgaagacggaaaaaaattgttacaggagtatcgcatggaggacaggaacctggacaacgtcctggaagatgtggtcgatctgctgtaccacgcgggatattttaccaacaaggacaaaaatgatatcctgctgaccgtaaaatccggttcggcctcagaaaccacggttaaaaatgtgaaccaccatcttgcagactatctggaggaatgtcagatcgaaggccgtgttttggatcagcatgtaagcctgacgaaggaattaaagaagctggcggaggaacaccacatatccgccggacgtatggctctgatcgaaaagattttggcaaaggatgacagtgtgacggccaatcagctggcgaatatgcggatcagtgatctggtggcttacgcaaaggacgagggaatctctctggatgccctggaagataagcttgaccacgccaatgactggtaccgaagcgataggcttgaatggctggaggaggagctggatcggatggaggagagtgaggcggcaggcgggaagtatgatgatcgttacgatgatgatgatcatgacgatgatcgttacgatgatgatgatcgttacgatgatgatgatcgttacgatgacgatgatcgtgatgatgacgatgatcatgaagatgacgatgatcgtgatgacgaccatgaccaacatgacgacactggccgtgaaggttgatgacgaccatgataatgaccaatatgataacgctggtcgtaaaggttgatggcaatcactatgaaaacggtggccgtgaaggttgatggcaatcactatgaaaacgctggccgtaaaggctgatggcaatcactatgaaaacgctggccgtaaaggttgatggcaatcaatatgaagacgctggccgtaaaggttgatggcaatcaatatgaagacgctggccgtaaaggctgaaagcgaccaatatgatgacgatgactattaagacttatgacgaccattataatagcgaagctgccatgataaagaaaccgctgttaccttcgtgaaaggtgatatagatcgaaggcagcggcggcctcaaaaataaatattgacacaattttgaacagaaaagtctgataaagggagcgcgggaatagcctaagaatagcagatggctgatatagtattccatgatttcaatactggtgtgcggtgaggagaagtgagtatgatatttttcatggtagtgggaggggagccggagagacacacacaacggcttattatagatgagaatgtgatcgtgcggattgggcaggatgaccggtccgcgcttgaggaattctataccctgacggagcgtgtactgtacagttacgtcctggcgatcgttaaaaatccgtatgatactcaggatgttgtacaggacacctatttaaaagtacgggcatccgcgcatctgtatcagaaacaggggaagccgatggcgtggctttttacgatcgcccgaaatctcgccatggacttattcaggcggaattcccgctttttatcagaagaagcatttgagatggaagacacgatggaatattcttatgtgacagaaatcacagacagactggttttagagacagccatgaatattttaacagagcgggagcggcagattcttttgcttcacctggtggggggaatccgacacagagagattgctgcgaatctggggcttccgctgtccacggtcttgtcctgctaccagcggacgctaaaaaaattgagacgatatctggaaggaaaggagtaagggcgatgagtaaaaaaatggagacaccacaaatcaaaaaatcgctgaaccgggcagtagaccagcttcctcagccttccctgcaaaaaataatggatacaccagtggtaaaaatggaacagatggacaccgccaccaggcaggagccattgaaaaacagctggctccacaaattgtgcagtccggcacaggtgcggcatgtggcagccgtatgtggctgcctgctattcttttttgcagcgggtatcggcggcgtatactcctatgaaaacatactggtagacagtattgtagacatggacgtgaatccaagctttgaattgaaaataaataaaaaagacagagtcctttcctttacacccctgaacgaggacgcagctcaggcggcagaaggacatacgtacaaggattggaacgttgaagatgcggttaaggatttataccggattatggaagaaaaagagtatctgacagatgatcggagaactgttttaatttcagtagaaaataggaatccgaaccgtgtaagccagctccagagccagttaagcaactgtatcagaaaaacagccgaggagagtaaaaaaacggtccgtatagtgacacaggaaaagaaaaaggatcaggcattgaatcagacagcccaaaattatcacatttccagtggtaaactacagtttatccgtatgatgacagcggcttatccggatctcgatgaaaaaactttgtcaaagatgtccatggaagaactttaccgcattatctttgatcgtgaaaaggaaaaaccggcgtggctccagatggacgaggaagactggaatgagtataaagaagaaatgagaaaagagaaatacggcgatcgagattctgatgatggagatacagatgatcatgatacggacgataatgatttgaccgataaagattcggatgaccatgattcagacgatggggatttggccgataaagactcggctgaccatgattcagacgatggggatttgaccgataaagattcggatgaccatgattcagacgatgaggatttggctgataaagactcggctgaccatgattcagatgataagagtccggctgatcaacattcggctgaccatgattcagataataaagattcacgcaataagaataagaataagaacacccgagatacagatgataaggattccgacgacaaagattcggatgcccgggcttccgttgataagaattcagcaggtaaagattccgaccacggggattcggccaataggaattccgaaggcaaggactcggaagaccgaaaatcaaatgcccgggactctgacgacgacgattccaaatcgaaagatgatgaagacagcgacgatgacgatgaacaccaaaattctgaagatgaacgcgatgacgattaagactccactccataaacaccccgggccacggcaggtattcctgccgtggcccggggttattttaactcatttacttcaattaatccagttttgtataaccgtagctgtttacaatcgcatccagcttgattccgttcttacaatccggacagttctccggctcggagagacggaagtcgggaagatcggaagaatcgaataccgcattaaccggatatccgtcgatctcattgactgcggcgaagataacggagatgccttccagaatgccgccgtaggattcgatgcagcgaatgctctttaaaatagtacggccggacatcgcggtagcgagaacgactaatacgtgtttatccttcagcatatgcttgatgttgtcacgaacgaccatctgtccggcggaatcgaattccggagtcacgatataagtagtcttgtggatattcgtggtggtaacgccgagctcggataattcctttgctacataggcgccgattacctcacagccatccatacagatgatggtatcgattggagtcttggaagcaaacgctttggaataatgcttgagctcttccgctcctacgccgatcagccctgataaatcaacacggtttacgtatctcttcaccatggatttggcaacctgctcagcttcctcctgacgcatcttcaatgtggtcatgtcaatgtagtagttaatgtgaaaacggtcggatgaaaaatgtccttttgttacttttaaagccagcttatcattgtctctggcgcgaattttggtttcctgccccatactcataaaaaacaacctcctttgtcatattacttctattataaccgatgtcaaccacagaaactataacaaaggttaacttttttcgttattctgaaaaatgatagctgtccagaagctgatttttcatgtgccacagctcattggagaggtccacatgcacctcgtgagggtttacaagacggcgggattcatcccagagcgtatccagttctttcttgcagtacgcctgaatgtccatgaccgcgggggattcgtaaacgcattctccatctttaaataccggaaccatcagatcacggagatgataggtgttgggagccaggtgcgtctttttccaggtctcgatgggatcgaagagcagcagtgaattattttcatcgtatttctcgccctccaggcagatcaaatcggcaatgatttttccggtttccctgctgtaaatacgcttgatacatttattgcccggattggtaatcttctcggcattttcggataacttgatcttcggcacaaattttccgctcttcttatctaatatggcagccagcttatatacgccgccgaaggacggacagtccttggaggtgatcagattcgtgccgactccccaggagttgatggcagcgccctggatctttaagctgttgatcagagactcgtccagatcgttggaggcggaaataactgcgtctgggaatccggcatcatccagcatctttttcgctttcttcgataaataggcaagatcgccgctgtcgagacgaattccgtagaaggtcagcgggattccggcctccttcatttcctgaaataccttaatggcgttaggaacaccggattttagcgtgtcataggtgtccaccagcaggatgcaggcggaaggatacagcctggcataggtgcggaatgcggtcagttcatccggaaagctcatgatccagctgtgggcatgagttcccttgaccgggacgttgaacatcttaccgcacagaacgttggaggtcccgatacagcctgcaatcatggccgcccttgcgccgtagataccggcatccggcccctgagcccggcgaagtccgaattccatgacaccgtcgccgccggctgcatatacgacgcgcgctgcctttgtggcgatcaggctctgatgattgatgatatttaacagcgccgtctcaacgagctgcgcctccataataggagcaatcacttttaccagcggttcacgggggaagacgacagtgccttccggtatggcgtaaatgtcgcctgagaatttaaagtggcgtaaatactccagaaagtcttcgccgaacagtcccgtggaacgcagatagtccacatcgtcctcttcgaaatgaagatctttgatatattcaattacctgctccagaccggcacagatcgcataaccgttgccgcccggatttgtgcggtaaaatgcgtcgaagattacggtctcattggcatccttttctttaaaatagccctgcatcatggttaactcgtatagatccgttaataaggttaaattgcgctggctcatatgtgttctccttctgaacgtttaatgtgggggcggagcaattgggaccgtaaggcccggggactctgtcctttttggacattataccataactttacaaaaacgcaacgtgattgataaaaatataacaatctatgatatcagaataatagagaagaataactataacaaatggagtaagacaaataaaatgataaatatatcgaataattatatacaatttgacaattacgaaataatttattaattttttataaagagtcttgcaaaatgaagagagatactatataataaagctatcaaaggaaagagatacaagatatagagaaacctcccgggaacaggaagcgggaaggataaaaaatagaaagaaaaggaggtagattccaccgaaaacataagtctcgtctgatttccaattaggaagcggacaataggaaaaaccattcggccacagtgaaaagccattccttctatgatgaataaatgcgaaagcatggatgaagtagcaggaaaaaatctatatatcttttacatatgcctatatttcgttataaactgcaaaggaaaattcatcgtatgagtcgtatgacgagaaagtatgattcgtccgaacaaaggtttccacatatgtagcttactaacatatagaagaatgaaaatgacgatgcagagataaaccagatgatagatgaggcccggtaatggagtggcgaaggtaaaaaaatttaatatagagcatccaggtacacaagtatcagtgacaaaacaaaaagtgagggtaaagtccaatggatgaagtagtctaggaacgggtatcgaagttcatgtgaatgagtcggtacccgtttctatttgcgtgcagacggctgccgcagcaggactgcgcagttatgaaaaaaagattaaggaaaaatgtaaaaaaacgcttgacagaaataactgtaactgatattattacagtataagaactgaaacaaaaaaagttacagaatggagcggatgagatgataaaagggaaatatttgattacggcgggaatcgccgcagcggttttagcactgacggcgtgttcgggaggccaggggagtgcttccggcaaggagacacagaagacggcggcgcagaaagcggaggccggtgcggaggcccaggcttcacagtatgttaagtttaagccggaagaggcaaaggaagttatggattcggacgatgcgctcatcgtggtggatgtaagaactccggaggagtatgcggacagccggattggcgatgcgattaacattccggtggaagacatcggagaggagatgccggaggagcttccggatctggatgcgaagattatggtctactgccgaagcggcgtgagaagcaaaaacgcggcggagaagctgttgggccttggttataagaatattattgatataggcggtattaaggactggccctatgagaccgtgtctggtgatgaaaaataaaaaatggtgataagaaaggaagttttgagatgaaaaagtatgatgcggttattataggatttggcaaaggcggtaagactctggcgggaaagctggccggtgagggaaaagcggtagcgctgattgagaaatcggataaaatgtatggcggtacctgcatcaatgtgggatgtattccatccaagtctctggtgagaagttcccagatgacggaagcaaagggaaagatctcttttgaggaaaaggcggaattatacaggacagctattgaggaaaagagacgcgttacttccctgcttcgaaaaaagaattttgacaagctgaatcatctggaagcggtgaccatttataacggaactgccagcttcctttccaatacacaggtaaatgtagtttcggcagacggttcggaggcgtttactttagaaggagatcagatttttatcaatacgggaagctctccgtttgtgccgccgattgagggaatagagggcaatccccaggtttatttaagtgagacatttatggatttggagaagcttccaaagaagctggtcatcattggcggcggctatatcgggctggaattttcgtccatgtattcaggatttggctctgaggtgacggtcattcagaacgaggcacgcctgattccgagagaggatgaagatatcgcggccgagattcagaaggttctggaagaaaagagcgttaaatttgtggttggcgcggctatttccgggatccggaaagaaggggactggtcttacgtccattactctgtcgatggaaaagagggagatctggaggcggacgcgattctggtcgctacaggaagaagacctaacacggcaggattaaatctggaagcggcaggcgtggaattgacggcccgcggcggcgtaaaggtagatgacggctataagacggcggctccgaatatctgggccatgggagatgtggccggaggacttcagttcacctacgtttccctggatgatttcaggatcgtgtggtccagccttcacggcggggcatatgatgcgaatgcgggcaagagaagccatattccgtacagcgtgttcattgaaccctccttctcaagggtcggtatgaatgagcaggaagcgcggggggccggtctggatgtgaagatcgccaaactgccggcggccgcgattccgaaggctgctgtcttaaacagaaccaaaggcctcttaaaggcagtgattgatgcgaagacgaataagatattgggcgcgatgctgttctgtgaggaatcttatgagatgatcaatatcgtgaagctggccatggatctcgatgcggactacacggtattgagggatcagatttatacgcatccgacgatgagcgaggcactgggtgacttgtttgcggtctgaaaaaaactggtctgatgaaactgaaaaaaatgcttgacaaattatgcattttcatatatctttgacttaaggatagttattgcttcgggcaagcttgaccttgtatgatcggatttgagtggcagcagccattcttattgatgatgcaaggtcttttttatttctaaaatgaatcggaagggggatttcgatgatctttaagaagagactgaacaacaatgcagtcattgcggaggacgaaaaagggcgcgagaagatactggtgggatgcgggcttgggtttcagaaaaaggaaggctccgaggtggaggagcagaagatcgaaaagattttttctctggaggacgccgggcagagggagcagctgaaggagctgctgcaggagattcctgtggaacacgtgaagctggcggacgatgttctctcctatgccagagttcatgtgaacagtaagatcagcacgaatgtcatcattccgctgtgcgaccatatttatatggcggtggagcggaagaagcagggaatcgatgtgaaaaatgtgcttttgtgggatatcaggcggtattatcccgcggagtatgatacgggactctatgcgctgcgctgtgtgaaggagcggtttcatgtaaagctggaggaagatgaagcgggctttattgcccttcatattgtgaacgcgcagatgaatttaaagcagaagacggtccatgagatcaccactgtcatgcaggaaatcgagacaatcgtccgcatgacctgtaaaatcaggctggacgcggaatctgtctattaccaccgcttcattacgcatttgaaatttttcgcggagcggatgttttccggaaaaacgtatgaggaccaggaggtggcggcgctggcggaggtgatccgggcgcagtatcaggaagcttaccagtgcggcaggaagattgccgattttatcggggataaataccaatatacgctgagtgaagaagagattctttatctgagtattcacattgcaaggatcgtttctgtctcgcggaaaccgcgggcatgattcataaaaggaaggaaaggaggaaagcccataagacatagcgtgatatttcattaagggcagttacattcagttggctcgaccttcagatttcaaagtcacataccctaaagcaagcaatggggtatcaaatatgcagcaccgtgaggggcagggtatttgaccctcgcggcagtcgtcagatggatccgcaagcgcgcccgcctgactcgttgctcgcggtaatcaatagaaagatggaggaaatgaaatgggaaaatatgaagaactggcaagagagattgtcaaatacgtgggaggcagagacaatgttaccggacttacccactgcatcacgagactgcgttttaagctggcggacgaagccgcggccaatgatgaagcgttaaagaacatggaaggcgtggtcacagtcatgaagagcggaggccagtatcaggtggtgatcggaaatcacgtgggagaggtctatgaggatgtctgcccgcttctcgatctggagaaagggaaggagacggcaaagccggagaagaaagagaagctgtttgaccggtttgtggatacgatctccggtattttccagccgattctgggaattatggcggcctgtggtatggtgaaggggctgaacacgctgtttgcggtgctgggattatatcccgacacatgcggcggatacttaatcatcaatgcggtgggggacgcgctgtttacctttcttccgctgttcctgggctatacctccgcgaagaagtttggtttaaagcccatgctggggctggcgatcggcgcgatcatgtgctatccggcgattcaggcgggaagtatttccgcttctatggctccgctttacacgctgtttgaggggacgctgtttgaatcgcctgtgtatatcacattctttgggcttccggtaatctccatggattatacctccacggtgattcctgttatttttatcgtatactttgcgtcgaaatgcgagaagctgttcaataagtttgtacccgatctggtcaagtttttctttgtgccaatgctgacgcttttagtggcgcttccggcgggatttctggttatcggtccggttgccacctttgcatccacgattatcgcggagacagtacttacaatcagaagcttttcacctatgctggcaggagccatcgttggatttacctggcagatcctggttatcttcggcctgcactggggatttattccggtctatatcaacaatatcatgaccatgggctacgacaacgtgatgatgccgttctttgcttgtacctttgcgacatcggccgtggttctggctatcttcatcaagacaaaggacagaaaactgaaggaaatggcactgcccaactttatttccggtattttcggggtgacggagcctgcgatctacggaattacactgccgcttaagaagccatttatcatcagctgtattgcaggcggaatcggcggaggcttctacggtttcttcaattttagaaaatttatgatgggcggaatgggaatcttcgagtttccggcgatggtggagccggacggttccatgggcaacttaatcgtggctgtgaccggggcccttctgaccatggtgatcgcgtttgttatgacgatgattgtctataaagataagaagaaagaggattctgctgaggacggcagaatggacagtggcagtgcagaccagggaacggctgacaacaacccagagttcgcatctcatgagttcctgaccatcatgagtcccatgaagggcgctgttattgatttaaaagacgtaaaagacagcgcgttcgcctctggaattcttggaaaggggattgctgttcttccggaggaaggtctggtggtgtcaccggtggacggaacggttgtgaccattttcccgacgctccatgcgattggaattctgtcggacgaagggacggagattctgatccacatcggactggatacggtgcagctggatggaaagggctttgaggctgcagcgaagcagggcgatcatgtgaaggcggggcagccgctgatgcggttcgatatggagctgatccgggaggcagggttcctgctggagacgccggttctgatcagcaattatgggaattaccagtcggtggaagccgttgtgaaggccgatgacgcggtggagtatcaggaaccgcttttgcggatcgttaaataaccggaaaggagatcggaaaatgggactgagtaaagatttcctctggggaggcgccactgcggcaaaccagtgcgagggcggctggcaggaggacggaagaggactctccaatgtggacgtgtgtccggcaggaccggaccgtgaagcagtgatacggggagagcacgtatcgcttgtctgcgacggggagcaccggtatccctctcacgaggccattgatatgtttcaccatttccgggaggacatacgcctcttcggcgagatgggctttaaagtctaccgcatgagcattgcgtggacgaggatatttcccggaggggaggaagaggagccaaacgaggcgggactgcggttctatgaggaggtgttccgaacgtgtcacgaatacggcattgagccgctggtgaccatctgtcacttcgactgtccggtgcatttaatcgaaaagtacggcggatggcggagcagggagatgatcggcttctatttgaaactctgccgcacgctgtttgtccgctaccgggagctggtgcggtactggctgacctttaacgagatcaatatgattctgcacgctccattcctgggcgcgggacttctgtttcaggacggggacgagagggaaaaactgaaatatcaggccgctcatcatgaactgattgccagcgccctggcggtgcagatggcacacgaaatcaatccggagaacagagtcggctgtatgtttgcggcggggagcgtctatccgtacagctgcaggccggaggacgtgtgggaagcactgaaaaaggaccgcgagaactattttttcgtcgatgtgcaggccagaggggagtatccggcctatgcagggagagcgcttgagcgggagggccttatgcctgtgatggaagacggggacgagaggatattgaagaagggaacggtggactttatctccttttcctattataacagccgctgtgtctctacggcagacagcgcggaatcggcggagggcaatctgttcgcctctgcgaaaaatccgtatctgacgtacagcgaatggggctggccgatcgatcccctgggacttcggattaccttaaaccagatctatgacaggtatgagaaaccgctgtttatcgtggaaaatgggctgggagcacaggattttcccgacgaaaacggaaacgttgcagatgactgccggatcgattatttaaagcggcatatatgcgccatgatggatgccgcagagctggacggcgtggatttactcggctacacggcgtgggcgcccatcgatttggtgagcgcaggcagcggacagatgaagaagcgatacggcttcatccatgtggatctggacgacgaaggcaatggaacgggaaagaggatgaggaagaagtcgttcggatggtatcaaaaagtaatagggaccaatggggagtgggcccgttacggggcagaatgacgaaaatacgcgacagatgcccgaaatttcgtcttttacttgacatttcctcccataaaatctataatgagaggacatataaggcataacctgccattatattataggaagaaagacgatgaaagagacagtaggaccgtgggaaatccaaagcgagccggggagggtgaaagcctggtgagagtagtcatgggaccgaatatcactctggagtctccggctgaaagctgtataagcggtaagccaggacgtggttcctacgttacagggaacgcatatgtcagtatgctgtaataggtggtttagcgaagcacggccttcgtcctgattacgggacgagggtctttttttcattaggaagcttatttataaaggaggtcaaaagagatgtataacaaagttcctacagatctaaattttgtagcgagagaaaaagaagttgaaaaattctgggaagatcacgagattttccagaagagcatcgataacagaaaaaaggctgaaacctataccttctatgacggccctccaaccgccaacggaaaacctcatatcggccatgtcctcacccgtgttatcaaggatatgatcccgagataccgtaccatgaagggatgcgacgtgccgagaaaggccggatgggatacccacggacttccagtcgaactggaagtggagaagatgctggggctggacggcaaggagcagatcgaggaatacggtctcgagccatttattaagcactgcaaggaaagtgtatggaagtacaagggcatgtgggaggatttctccaagaccgtcggcttctgggctgatatggatgatccgtacgttacctatgagaactactatatcgagtccgagtggtgggctttgaagcagatctgggaaaagggcctgttatacaaaggctttaagatcgttccctactgtccgcgctgcggaacgccgctgtccagccatgaggtggcacagggctacaaggatgtgaaagaacgctccgctatcgccagattcaaggtgaagggcgaggacgcttatatactggcgtggacgaccacaccgtggacgcttccttccaacgtggcgctctgtgtgaatcctaacgagtcctatgtgaaggtgaaaaacggagaatatacgtattatcttgcggaagctttgtgtgatacggttctgaatagtgaatacactgtactggagcgctgcaccggaaaggatctggagttcaaggagtacgagccgctgtttgatttcgtgcatccggcgaagaaggcattctatgtgacctgcgatacgtacgtaacgctgacagacggtaccggagtcgttcatatcgctccggcattcggtgaagatgactccaaggttggtaagaaatacgatcttcctttcgttcagctggtggattccaagggcgagatgacgaaggaaacgaaatgggcgggcaccttctgtaagaaggccgatccgctggttttaaaggatctggaagagcggggcttactgttctccgcaccggtatttgagcacagctatccgcattgctggagatgtgacacgcctctcatctattatgcgagagaatcctggttcatcaagatgactgaggtgaaggaagacttaatccgcaacaacaacaccatcaactggatcccggagagcatcggtaagggacgcttcggcgactggctggagaatgttcaggactggggcatcagccggaaccgttactggggcactcctttaaacgtatgggagtgtgagtgcggccatcagcattctatcggaagcatcgaggaattaaagtccatgtctcctgactgccccgagacaatcgaacttcaccgcccatacatcgacgcggtgaccatcacctgcccgaagtgcgggaagcagatgaagagagttccggaggtaatcgactgctggttcgattccggttccatgccatttgcgcagcaccactatccatttgagaataaagagctgtttgagcagcagttcccggcggatttcatctccgaggctgtggatcagacgagaggctggttctattctctgctggctatctcgaccctgatatttaacaaggcgccatataagaacgttatcgttctgggccacgtgcaggatgagaatggacagaagatgtcgaagtccaagggcaacgcggttgatccgttccaggctctggatgaattcggcgcagacgccatccgctggtatttctatattaacagcgcgccgtggctgccgaaccgtttccatggcaaggctgtcatggaaggtcagcgcaagtttatgggtactttatggaatacgtacgctttctttgttctctatgcaaatattgacgaatttgatgcaacaaaatacaaactggaatacgataagcttccggttatggataaatggcttctgtcgaagttaaatactttaatcaagaccgtggacaccaatctgggcaattaccagatcccggaggcggccagagcacttcaggagtttgtggatgacatgagcaactggtatgtgagaagaagccgtgagcgtttctgggcaaagggcatggaacaggataagattaatgcctatatgaccctttacactgcgcttgtgaccgtcagcaaggtggctgcaccgctgattccgtttatgacggagcagatctaccagaatctggtgtgcaatatcgataagacggctccggagagcatccatttatgcgattatccggaagcggatgaatcctgcatcgatgagaagctggaagacaacatggacgaggtcttaaagatcgtagtcatgggccgtgcggccagaaatacggcgaatattaagaaccgccagccgatcggccggatgttcgtgaaggcgcctcatgagctctccgtattctatcaggagatcatcgaggatgagctgaatgtaaagacagttgtctttacagacgatgtccgtgatttcaccagctacagctttaagccgcagttaaagactgtcggaccgaaatatggaaaacagttaaacaacatcagaaaggccctttccgaggtggacggcaacaccgccatggatactttgaatgaaaagggcgccctcacgttcgactttgacggcagtgaggtggttctgacgaaggaagatttactgatcgatacggctcagatggagggctacgtatcggaaggtgataataccgttacggttgtgcttgacacgaacctgacaccaaaactgatcgaggaaggctttgtccgcgagttgatcagcaagattcagacaatgcgtaaggaagccggctttgaggttatggaccatatcctcatcaccagcgaaggcaatgagaagattgccggaatctttggcgcgcacggcgaagaaataaagagcgaggtcctcgcagaaggcatcacactgggtaaggcagcgggatatacgaaggattggaacatcaatggtgaaaatgtcactctgggcgttgaaaaagttcagtaatacgaagcgaggattctctcagattgaaataaccgataggaggtcattcacaatgagtatgggatttgataaagaaacctttaagaaaagcgttatttataacgtaaaaaacgtattccgcaagacgatcgatgaggctactccggagcaggcgttccaggcagttgcctacgcagtaaaggatgtcatcatcgatgagtggattgcaacccacaaggagtatgagaagcaggatgcgaaaaccctgtactatctctccatggagtttttaatgggccgtgcccttggaaacaatatcatcaatatcatggcgctgccggaagtgaaggaagttttagatgaacttggcttcgacttaaacgccatcgaggatcaggagccggatccggctctcggcaacggcggcctcggccgtcttgccgcctgcttcttagattccctggcgacgctgggctatccggcatacggctgcggcatccgttaccgttacggtatgttcaagcagaagattgaaaacggatatcagatggaagttccggatgactggttaaagaacggctatccgttcgaggtacgccgtgccgagtatgcgacggaggtaaaattcggcggttacgtgagaactgtctgggagaacggcagagagcatttcgttcaggagggatatcagtccgtccgcgccgtcccctacgacatgccgatcgtcggctacggcaacaatgtggtgaatacgctgcgaatctgggatgcggaggcaatcaataccttcagtctggattccttcgacaagggcgactaccagaaggcagtggagcaggaaaacttagcgaaaaccattgtcgaggttctgtatcctaacgacaaccactacgcaggaaaggaactccgcttaaaacagcagtacttcttcatttccgccagcgttcagagagcggttaagaagtatatggaaaagcatgaggatatccataaattcttcgagaagacagtgttccagttaaacgatacccatccgaccgtggctgtgccggaattaatgcgtatcctgttggatgagtttaacctgacctgggatgaggcatgggctgtgacgacgaagacgtgtgcttacacgaatcacaccatcatgtccgaggctctggaaaaatggccgatcgagctgttttccagactgctgccgagaatctaccagatcgtggaggagatcaaccgccgctttgtggagcagatccagcagatgtatccgggcaaccaggataagatccgcaagatggccatcatttacgacggccaggtgcgcatggccaacttagccatcgtcggcggattctccgtcaacggcgttgcaaggctgcacaccgagatattaaagaaggaagagctgcgtgacttctatgagatgatgccgcagaaattcaataataagaccaacggcatcacacagaggcgtttcctgcttcacggcaacccgctgttagctgaatgggtgactggaaagatcggaagtgaatggatcaccaatctgcctcatatccaccgtctggcggtatacgcagatgatccgaagtgccagcaggagttcatggacatcaagtaccagaacaaggtccgcctggccaaatacattaaggaacacaacggaatcgacgtggacccgcgttccatcttcgatgtgcaggtaaagcgtcttcacgagtataagcgccagctgatgaatattcttcacgtgatctatttatacaaccagctgaaggataatcccaacctggatatggttccgagaacctttatcttcggcgccaaggcggcggccggatataagagggcgaagctgaccattaagctgatcaattccgtggcggatgtaatcaataacgacaaatccatcgacggaaagatcaaggtggtgttcatcgaggactataaggtgtccaacgcggagatcattttcgcggcggccgacgtcagcgagcagatttccacggccagcaaggaagcatccggtaccggaaatatgaagtttatgttaaacggtgcgctgacactgggaaccatggacggcgccaatgtggagatcgtggaagaggttggagctgagaatgcctttatcttcggtatgacctccgacgaggtgatcggctacgagaacaagggcggatataatccgatggagatttttaacaataattaccagatccgccgcgtcctgatgcagctgatcaacggttacttcgctccgcaggatcctgagctgttccgtgacatttataattctctgctgaatacgcagagcagcgaccgcgcagatacgtacttcatcttaaaggacttcccgtcctacgcggaagcgcagcagaaggtcgatcaggcttaccgcaatgagtcctggtgggcaaaagcggctattctgaatgtggcctgcagcggtaaattcacctcagaccgtacgatcgaggagtatgtaaacgatatctggcatctggaaaaggtgaaggtagaaatagaagcaaatcagtaaggcagtgcagaataagcgcttaagagaattacggtgggaaaatgcagcgagaagcgccgtcggcaggacggaacagcgggcggcattttcccaccgttttgtttttgagtgccgtctgcggcggggatttgatttaaaagaggaaagcgggggagaatatgacagagagtacagtcggaaaacggggatttgaaccgtcgaaaataacgatttacgtgaaaaacagaggtattgtgctggaggaatcgtccatggctcttgtaaataaggataccggtctgattatggccatgggaaatgaggcggaggaggcgatggatgctccgccgactcctgctgtcgccgtcaatgcgctgcggaggggaatcgttgcctattttacattgtcttcaaatatgttccgtttttatttacaccgggctctgggatatgatcactcatttgtgaagcgtctgatcggtatctccataaaaaagccgcggattgcagtgtgcgtgccggaggaactgacggaggtggaggcaaaggcattttcagaagccttttaccaggccggggcgaaaacggtgtatctcagcagtatgcctttggaaaccgccgtaacctctctgggggaacagtgctccgtgtttgtgggaattacatggagtgggaaggaaaaggaacgtttctgcataaacgagaattgtccgcatagaattttttaaaggaacttgcggaggtttttagtggcaaaaaaagttgtaatgatatgcgtcatggcattgctgcttccatatataataaccctggcatggacaggcagaatcgaggaaaagaagcaggtaccgctcattaccagcggaaaaaaggtgattctggaccggaaaaacggggaatcctatatggacgtggaagagtatctgcccggagtcgtggcaaagcagattccggcggagtatgggaaggaagcgctgcgggcgcaggctgtgatcgccaggacgtttatttaccagaagatgaacggtcaggacgaggtgaaggaatcggagcttcatatggaatatctggaggagaagcagatggaggccatgtggggaagcgagtcctttgtgacgtattttcaggcggtggaagaggccgtgcgctcgacggcgggcgaggtgatcacctatgacggcaagctcattgagccgctgtttcaccgggccagcaccgggatgacgagaaccggagatgagagccatccgtatttgcaggcggtggccagcaaacgcgatgtggaggcggaaggctacctgaccatgatgacctggagcaaggaagattttgccggcaggattaaccagatcgccgacagcgtgcctgttgatgcaggccagcttccccagtccattcagatcatcgtccgcgacgacggcggttacgtgggacagattcagatcggtacaaaggtgtataccggagaggaggtccagtatgcgctggggctgccgtctccgtcttatacgctggaggagtatgacggcggaatccgggcggtctgccagggcgtgggccacggttacgggctcagccagtacggtgcgaagtgtatggcggaagagggaaagaccgcggaagagattctaggatttttttataaaaatattgttctgatttctgaataactctttctcctttggtaagaatattaccgaggtgataaacgtgaaagagaaaatgagtcaattgttcaaggataaagtattccttgtcctgttggttttaggcctgctgactatagttgctgcggcaggagtcattaccattcaaagaggaaacaatgatggccagagtccatatcttgaagttccggaccagaagggtgtcattgcagaagagacgataccacaggaaaaccaggtagcagttgccggtgattccaacgctgagcagaatctggatgcggatacacaggttgctgattccgccaaggctacagcgaaagcagagacagaagcagaaaccccggcggttaaggccggagcggaaaaggaggcggccgcagcgcttgtcctcaattttaacgatgcaacaaagatggcatggccggtatcaggaaatgtcattctggattacagcatggagtccaccatctatttcccgactcttgatcagtataaatgtaatccgggcatcatcattcagggcgccgtgagcacaccggttgtagcacctgcaaacgcaaaaatccaggagatcggttctaatgaagaactgggcaattacgtcattctcaatatgggaaatgactatacggctgtctgcggccagttaaaggaactgcaggtagtggaaaatgaatatgtcgctcagggcgacgttctgggctatgtggccgaacctacgaaatattattcgattgaaggcgcgaacttatacttcgagctggagcacgagaatcatccggtagatccgctggatttcatgcagtgagagcgtgcggaccggactgtaccatacggtgaaaaaaagaaggcagggcagaaggcttattgaagttttctgttctgtttttttgtgtaaatggaggtggggatgtggtataataaaaatgaggtttgtgagcggtatttttatgtgtggccgtcggggaaaggagaaaaataatgaattacgatatactgaagaagaattttgaaaagcatggatttcatactgtatatttcgagacaggggaggaagcagcttcctacataaaagagatggtgaaggggaaggcggtggcactgggaggcagtgtgacgctgcaggagataaaactgaatgaggctctggacggggagtgtgcgctgacctggcactggctggagccaggggcagagacgcttaagaaggcgaagcaggcagaggtctatatctgcagtgccaacggggtatccgagaccggagagattgtcaatatcgacgggaccggcaaccgtgtctccatgacgatctacgggcctcagaaggtgtactatctggtaggcagaaacaagatttcgcccgatatgcacagtgcactcatgcgtgcaaagaacgtggcggcgccgaaaaatgcgctgcgtctgaaccggaagacgccctgtgcggcgaatggaggggaccgctgctacgactgtgacagtccggaacgcatctgcagagcgaccgtcatccaggatcgcccctgtaacggtgtggaggcggaagtcgtgtttatcaacgaggagctgggctactaaaagtaacagttcagcccccgtttccggctgtcgcggtccttcccggcgctttcgtttcccggacctttcctgtgactttgcagggcattagcagttcttaatacgcagaatttttcgttcaggggaaatccccacctgtctgagcgcagcgagtttggggattttcactggtttttagaaaaatcctgcacatttagatatgcttatgcccgaaaccggaacaggaaaggtccgggaaacgaaagcgccgggaaggactgcgacagccggaagtgagggctgaactgttactactaaaatgttataaaaaaataataatttgttcatatgtgaactaaggtaatatgctataataaagacgaaaataatgtgacgggagtgcggctatgaacatattgttttttttaacaccaaagtgtgaagtggcatatatttatgaggacgagactctgcggcaggcccttgagaagatggagtatcacaagtactccgcggtaccgattatcagcagaacgggaagatatattggaaccatcacagagggcgatatgctctggggaatcaagaataagtttaatttaagcttaaaggaggccgagcgcgtaaccgtggcggcgatcgaccggagactggacaaccgtccggtatatgccaactccaacatggaagatttaatcgacaaggcgctgaaccagaactttgttcccgtggtagatgaccagaagaacttcatcggaatcatcaccagaaaggacattattcgctattactacgataagtcccaggaatgcagtcaggcgacacaggcctgccggaacgcgggagagaaggcacggctggtgctgggataggaattgtgaaaaggaatcacaggcaggaagcaaggatatatggcgtttacgtgctgcggcaggaagtgagtaatggcacaggagagtaaacggaaatagtaccagagtgtaaaacgcctgtcggcgggaacggttacttttgtaactggtgtttcccggcggcaggcgttttttatgtgtgtttatgctcttgtcattttttctttctcttcgtttagcagagagatggaatcggcaaaggtattgtcgatcactttaagcagcgtgtcctgctccagagtcggggagtagtaaaagccctgctggtagtcgcatccggcgttcgtcaggatattcacctgattctcggtttccacaccttctgcgatgatgtttaaatccagatccttggcgatgtggatcagtccctcgatcacgcagcgcgacttcgggttcgtctccagctgccatacgaataaacgttccagcttcagcgtgttgaccggaagctccaggatggtggctacgccggaatatccggaaccgaattcgtttaacaccagctctacgcccatgtcggacagttcctgcagcatgatattgatgtttaagtatgctgtggttagggcgctttcctggatctcgatggcaagcttgcccttggggatctggtaggtatcgatgacgcgtctgacctcatccagaaaatcttcctgcaaaaagaggatagaagatatcgggagagcgatggaatcgaattccttgcctgcctcggtgagctttgcgatacactggcccactttatccagggcgaaatattcgagggagcggatctggccggagtcttcagcgatcggaagaacctcgctggctccgatgagccccagccccttgatgaagatgcgcatataaaactctgcgcggctgaactttccggtctccatattaagcgtcgggcggtaacggacctcaatctcttctttttcaatggcggtctttaagtataatgcgatggtgtggcggcgaagcagctgcttctgaagcgtactgtcgaacataatggcctggttcggtccgccttcttccgctcttaagactgccaggtcgagacattttaacagctcgtccggcgtcgcggcgtgtccgggataggagcacatacccatctgtacggaacagaggcagtccgttccgttcactttccaggcgtgatcaaactgttcggcgatctcttctgcaagatcggatgcctgtccctgtgaatactggtcgaggatcatgatgtattccacaccgatgtagtgataaacaggttttcctgtcttttcttttaaataggtgagaatctggcttaaaaggttctcacagtaatcgtaaccgaatacctgattcagtcgtttgaaattctctatgtatacttttaatacaactccgcggtctgagggtgtatccatgacttccgacagatgccggtagcatgcgtcacgttccaacttgctttcttccgccctttcagtgatcacgggctcagattccgccggtgacggagtggggattgtcttcttttgaaaccaactcatgtggtctgcctcctgtttttgcaattattaacttcattgtagtataaaacaggcatgaaatcaaggaagatttcggtaaatatcgaacctactttacgagaagcatgacagctcccaacaaaaacaaaataacgccggtcaaccggtttaaaagttttggatctgctttgtttgcgaaaacagcggcgattcgggcaaacaggaaggtaaacacgatacagagtacaagcaggaacagatccggtatgccgccgatggcaaaatgggagagggagccggtcaaagccgtgaacgtcatgataaatacgctggttccgacggcggtctttaattcatatcccagcacactcgtcagcagcagaagcatcatcataccgccgcctgcgccgataaatccgcagatgaaaccgaccacaatgccgctcagtatggactggatcagcttttgccgcatggtcttggattcctgtgcgtctttggtcgtgagaaccggtctcactatgaatttaatgcccagaagcatggtgaggaagacggaagcgttccccatggcgtgattgggaaccagggaggagatgtagcttccgatcagggtgaagattaagaccgcggccatcatcacgataccgtttcggatatcgaggtttttgtgttttccgtaggtgtaggccgatacggcgctggcgagaacatcgctggccagagcgatgccgatcgcctgataggcagggactcctaaaaatgtgatgagcatggggctgatgacggccgccgcgctcattccggcaaagcctgtgccgaagccggctccgaggcctgcaaagagacatacaatgatttttactagcatggtaagaccttcttttcttttgttttcttgtttattcccgcgggcaacgagctaactgcgatggctgcatgagtttttggcggcggctgtggggggcaaatactttgctggtcatggcggttcaaataccctgttggtcatggcggctcaaatactctgctggtcatggcggttcaaatactctgctggtcatggcgattcaaatactctgctggtcatggcgattcaaatactctgctggttatggcagttcaaataccctgttgctcacggcggttcaagtttcatgcctccgctgcttgctgtgggggatttgattacgtttgttttagattatccatcatccgttttaaaagatccgagaacatctgccgttcttcctctgaaatcccgcggttcagccgttcgaagaaatcctcctgcgtccgttttaaatcccgggcgacaggggcggcggagtctgtcagctttaaatgaattttcctgcggtcggcggtgtcctcgtgactctctaagtatcccaggctggtcagcgactctacggaagccgatactcctgatttcgccagcatgcggaaataggagatgtcctttgctgtgtcgtaatccggattattgtagagaaacagaataatgtcggcatccatcagcgataaatggtgctgtgcggccgcggtctgaatgacctgattgtaaatcttgtgaaaggacttagctccggataaaatatcgcgtgtctccatatgattcacctctttttctttggatttccgcgagcagccagccgggtgccaggctgttagctcgagcatttggcgactgccgcgtgggtcaaataccctgccgcttgcaacggagtatttaactgatagtataacagttgtaattagttttaaaatgaactgttctttttagaactatatcaaactgttctgggtttgtcaatagaaataccggtgaaggagaaaaggaagaagtaaatttcaggatatcggggaatgataaccgtgaggtgaaaatatgaaatcaatctggacacagacaacgaaaatacccggaagaaatccgcttcccggtaataagaaaacagaggttgcagtaatcggagccggactctttggtattctggcggcccattatctgaaggaacagggaaaagaagtgattgtgctggagggcaaccggatcggaagcggccagtcgggatatacgaccgcgaagattacctcccagcataacctgatttaccagaagcttgtaaacaccatgggggagaagcatgccgccgcttacgccatggcgaaccagcaggctattcgggattatgagaagttaattgacagataccgcatagcatgccactttgagaagaaggatgcctatttattttcggttaatgagtcggaaattctgaggcaggaggcggactgtgctgcccgatgcggcataccggcttcctttgtccgggagacagagcttccgtttcctgttcacggggcggtgcgttttgcagatcaggcacaatttcacccactggagttcatcgaagcgctctccggggatttaacggtctatgagcggacgactgtacgtgaggtgaaggggcatgagattatcacaaacagaggtgtggtaaaggcggctcatattgtatttgcgtgtcattttccatttgtgaatattccgggcttttattttctgcggatgtatcaggaaaagagctacgtgatggcactggggcctgtaaaggagctggagggaatgtatctggggattgataaaaactcctattcctttcggagcgcgggggatacgcttcttttgggccatggaagccatcggactggaaagtgtccgaaaaagaatccttacgaagagatgcggcggttgagagaacatttttatccggacacggaggaatacggaagatggtcggccgaagactgtatgagtgtggacagtgtgccttacatcggccatttctccggcgtgcttgcggactggtacgtggcaacgggatttggaaaatggggtatgacgacgtcaatggctgcggccaggatcgtgacagcgcagattatgggaagaaggacgccggatgatgaggtatttactccgcagcggttcaggcctaaagcggcggcgtccacatttctttcccatgccggttattctgcggccggactcatgagtggcgctatgccaaaggttccccggtgtcctcatctcggctgcaggcttgtatataatcggatggacgggcgctatgagtgcccctgtcacggctcacaatttgaacaaaatggaaaaatatgcgttggccctgcacaagaaagccttcctttcataaattgatattagaaactcatcatattgaaaggagtatttcatcctatggattgttatacgaaacaaagatgtcctggctgccagccagtgccgcagggcgctaaaggccgtcaggatgttccaatgggcccaggcccggtgatccgcccggatcttcctctgggatccggcccggccgttcgccacgattcggcgtcgcagccgaatatgccgatggggccaggaccggcgatgccgccggagatgccgatggggcgcggaggcgcaacgcagccgaatatgccgatggggcgtgggggagcgacgcagccgaatatgccgatggggcgtggaggagcgacgcagccgaatatgccgatggggccggggccagcgatgccaccggaaatgccgatggggcgtagaggagcgacgcagccgaatatgccaatgggaccagggccggagatgcctccggaaatgccaatggggcgtggaggcgcgacgcagccgaatatgccgatgggaccagggccggagatgccgccggaaatgccaatggggcgtggaggagcgacacagccgaatatgccaatgggaccaggaccggcgatgccgccgaatatcccggcaggatgtggacctaacatgcgttcagagatgccgatgggaccagggccggcgatgccgccgaatatgccgatgggtcgtggaccagcaatgcagccgaatatgccgatgggtcgtggatcgatgatgcagccggaaatgccgatggggcgcggatcgatgatgccgccggagatgccgatgggacgcggatcgatgatgcagccggagatgccgatggatcgcggatcgatgatgcagccggaaatgccgatgggtcgcggatcgatgatgcagccggaaatgccgatggatcgcggatcgatgatgcagccagaaatgccgatggatcgcggatcgatgatgcagccgaagatgccgatgggccgcggatcgatgatgcagccagagatgccgatgggtcgcggatcgatgatgcagccggaaatgccgatgggtcgcggatcgatgatgcagccagagatgccgatgggacgcggatcgatgatgcagccagagatgccgatggggcgtggagttatgccgcagccagagatgccgatggggcgtggagctatgccacagccggaaatgccaatgagccgtggcgcaatgccgcagtcgaatgcaccgatggactcaggtacggtcgctcgccgggaggtaatgtcaggccgtgaatcagccgttcgcccagaaatgccgacgaattccggttctatgaattcatcctgtgatatcgatcagtttccggtaggcatggcatacgttccgtggcagcgctggcagcaggtctatccggttgaaaaagcaatgaacagagggacaattttcccggatctggataaaccgttttccatggggaggtgcagataatggcaaataccgatatgaactgcagcgctctgcttcaagcagtctatgaggcgagcttcgctatggacgatgtgattctctatttggatactcatcccagtgatcaggatgcgctgaattactaccaatatgtatcagatttacggaaacaggcaatggatgcctatgaggctcagtgcggcccgctgatgtttgacgaagtccggtccgataattactggacctgggtcaacaatccgtggccttgggaaggagagtgcggctgatgtggagatatgaaaagagattacagtatccggtaaatattacaacaccgaatccgaagatggcgacgtttattatgagtcagtatggtggcccaaaatgcataaacctataggaatgcccggaaaaccttgtgtttacaaggaattccggggttttatatatattgttatttactaaaaaatggagtattatgtcaactggaaatagcctgataatttgtgacgatcagctaagcatagtagtagaaatgaaattcattcatctgacggtcgaaaacaattttttttataattctacgaacggcatttcccttggtgacgttgtctatatccggatccattagtaaatcataaactgtagtgattctttttaagatttcctgcatgtcaggaccttccggttcgtctggagtttcttttagctgttccaactcatcaagaatatgggtgcgctcatcctgcagccggagtttgtttgctttatattcctccagcgaatcgattccgctttcataggcatcttttacacgcatctctttcatggctactttttctaatgcttccgagagtcgggactcttcactaatcaccttctgatctggttttcgtatgtattcatactgcacagactgatctgccattacctgccggagggaggtcagaacagcttcctctgcctttttgactgatactgaacaggattctctgtgaacgccctttccatatttccagcactgaaagaaatccggccgtttcttttgatcattcgagcgattgtaggaaaggcttgcgccgcagacgctgcattttaatatgccggacagccagtgctggcaggatgaggtttcacgccggcttttgggtctgtattcttctttaatacgttgctgatttgattcaaatatatcagtgatcgatggccgcgtctcatgggccccctgaaatttaataccgttccagacaacaatgccattgtagaattcattgacgaggattcggtaaataccgcggcggtcaaatcgatttccacgtttagtgcgaaaacccatgtcgtttgcctcccgggcaatggcagtcatgtctttgcctttatgaaaagactggtggatgaactcaacaattacgtattccttttcaatgatgataaagggctttccttcacctacagctgcatatcccaggctgggtgaacactgatagccttctcgtaatgctttttccgtcataccacgcatgacctctccagagaggttaaaggagtagtattcgtcaaaccattcgataatactttcaatgagacgaccaaacatgccatctgcaattggttcagaaacacttttgatctcgacgccgcatttcttgcggagaacgcttttataaaatacactctcgtcctgatttcgagcaaaacgtgaaaacttccaaagataaagccgcttgaaagggcagggctgcgttttggccgtggccaccatgcgttggaattcttgccggttgtctgcccggcgtccggaaacaccttttttctctatgtaaacaaattctttgggtatgacatagccatcagcctttgctgactccagaatgacgcggagctgtgcatcgggggacagttctgtctgatcatttgtactgacgcggatataggcagcacctatttccacggtggattgggtggtcatgatatcatctccttggtctagtgtattaattttgggtataaaaaatacgccccttgtcaggacgtaccagaaatgatataattcacttgttgaaggtgatttatcttccggttcgtccggcaagagaaaatctatgtaaagccgttcggtgttggtagcaccggacggttttttgacagatttttaaaactgcatatcagctaatccaaatctgttcttcactggttctggggcgacatcatgttcatatacaatttcttcgttatatatcatgttattatactcaggagaggtgtaatattgcccatctatgcaaactacatttccaccctctatgtcatcaattaatccgcttatagtaccataagatgtgggaacccaattagaataatcaatggaaccatcagcgttataaattgtatttccaaaaggattggtgcatattccagattcattaaaatgataagtaatttgtccatcgacaaggtctttggtttgcatggttccttcagcatcaacatagtaccaatccttcccatttgtatctactatccacgaactggtaggatacgtaccgtcatcatttttgtaccaccagcctctactgtcatgtttccattctccagccagaactgtggatgccattatagcggacataacgagcgttgtaacaaataattttatcctcttcatgaaaaccctcctaaatttcggcatcgccgtatttttactaaaaagccttaggctattttaaccccattttgcgaaacattcgatatgctgatgcgtattctgacggtattggaagtccggcctttaatgttcgttgcatatcaccatagatttcttctattgtaggtttgtattcttcctcttcctcctcattttcgtagtcagtattttcatgacatgctttttctattaataattccaactgtctctccggttcggagggcctatgtgtggcatgggcaatattttcgtaccatttcctataatccatcagagctctgtttgatgcatcataggaaagaccaaatatatcatggatctgatcagcagtttcgcatctatatttgtggatcatgatacgcggagccagaaagtgactggcaaagttatcggcgtcatcttcggaatcggtattgagaaaaatatgtccaagttcatgagctattgaaaactttattcttccgtagacggagtgctctatgtaatacaaagtatcatctattaaacaggcatcttcgctcaattcaataaatgctttttgtttttttacggttaaatctgaaaattcttttattttatatccacatttttctactaattcaaaacagtctattggaaattttttaatattgtattttttataaatgttataaatacattcatacagagggactaaatccattttacggctcctcttcctcatcgtcatcagataatataatacgagcaagtctcattttttcttcctgtgaaagattttttcggctacgggtataaacggtaaggacatctttgtaatccggttcgatcttaacacctttagacatctcatccaattcttcaactgtaatacctaaagctttacacatgactataacgttattaacgttggctttgccagctccgtttttaagaattgtatataccgttgaatacggaaggccgcatttttcggaaaaggagcgagcattcataccttgttctttgataagtcgttccaaaacctttgctttttccatcgtttgtacctctcttttatgatacctcaattatatatgataaagcataaaaagtaaataaaaatatttggaaatccgtatattttttaaaatacgaataaaaatatttggaaatccgtatatttttacttgacaataaacgaatatccaaatataatgtgtgtatgaagtttggaagtccaaacatgaaaggaggatatcaatgtacaataatttacttaaggcaatgaaggataagaaaataaccttcacacaaattgcagaattactccattgccaactgaatacggtgtcggataaggcagatggaactgtcaagagcgggttttctatcgatgaagcgttgctcatcaaaaaagtatttttcccggaatatgacatcgtatatctttttgaaagagagattaatgcagcatagaaacaaacgtatgttcgataaagcgactatatcactatcgttcatttgtgtcaatgggaagatgagaaaggagcgtgagagtaagatggggggaaaagaaaagaagaaaccgcatatcactatggtctggatagcaattgcggttctttcgattaatcaggctgtcggggcgtatcaggattatcagatacatcagcggcttcggaatcagattcaggcacttcaagaacagaatttgaatctgttgcaacgaatgaataattctctggctgagtatttaggcaatcaattaacgcagttaccgacaaattaagtttttctaatgattcggtgtatttttcaaattgaactgtttcagcttgcgagcttatggcatcggcagaactatcaatattgtgaaaatggatagttaaccataccccaaacaaagcaataatgtttggcaatatataggataaaaagaattccagtgttatgcgccgtttggaaattgggcttacagtagcaagggggatatcacattcatattcctcttcattaataagggaagtgtacaattcttcaggtacttcgacatggtcgctataaaaggatatattttgtagtgctgaagaaaagtcaacagaaaaatgggagctaatatctatcaaattttgctgaatattttttgttaaatcttgaataacagaatcattgacggctaaagtatcacgaataccagagacaagagatgcgttccatacctcttgcatctgccggacaggtgcagttaaagcatcaagttgggcttgcagttggatagccatatcgttttgcagagagatagtcattgtttgtgctatcgagcgttgaaattctaaaagagccggttggaaagccgatgagggggctaataaggatggcttaaagctatcaaccaatgacatattaattctttctaaggaagattgaaatgcagttagtgcagcagtgattgattgatgattattattcataatggcatacttctttcttttgtattccggtggcagccggtaagacaattatagaacggagaaagccagaaatcaacaggcaacaagtacaaccagttatacatacaatctaccagagaggggtggtgatgtggaaaaatacaggattgtaaactacatcgaggtagacggagaggatattccaatggaaaagctttctgaggaaaaaaggagtaaactcccctgtttattagctgacaaaatgatgatatcagcaggatacaaaaggaagaccgcctgagggcgggactgatggacaagtagtgagaggataaaaaatgcagaagtacattgacaacctcgacgacttcgaggacgacagccggccgccgattttggactgggtggaatggctggtaccgcggattattgcggcgggagggattatgttgatactgttgatatgcgcgtcgctggaggcactgtgagaggaggtgaaggtgatgaaacggggcaatatagattcggcaattgaatacttaaaacgtgatccatgtatggataatacacgctcggcagtgaattttatgcttggctggtttgaaaacgaagcagagaattgcgagcggtcgtacgtatcagccgatctgaaaaggttgttccaggcaatcgtggatattgagaaagaagaaaaagaaacccagacgggtggagccgtccgggaatcaaggtaactactaacaattttacactcctattatatcagagggaacaggagatttcaagatgaaagaaagatatcacaggctttgggtatctctaagagagcagttgacagatcaggaaaatagtaaaggcggcgaaatatattcgtccaagtccgatgtgctgcatgaggttctgacattgatggcaaaaatggaggctgcgcaatttttggaggattgaacgatggtaaaagcaaaagatttaaaggttggacaggttgtccggttggaatgcggagatgccggaaactggggaaacttcgaagttgataagattactgccctggaggattccgtggacgtgctctgccattatggagtgatacatatggagttttcgtgggaaacggataagatgctggaggtgatcgagtaatggcaaaggtgattggtattatgggagagtctggatccggcaagactacgtcgatgagaaacctggatccgtctgttaccttttacattgattgtgataagaaaggcctgtcatggaagaactggaaggagcagtatcaggaggagaaacataattattttaggacagatttgccgtctacggtgctaaatctgctgcagaaaattcaggatcaggagaacatgaggcacattcaaacaatcgtgattgataccatcaatggaattatggtgggagaagaaatgcgtaacatcaaggttaatggatatgggaagtggacagatcttgcctcctacatatatggaattgttgattatgccctgaccatgcgtgaggatctaaccgtgattattctgtgccattcggaaaccatttctgatgataacggctacgtgtttacccggattaaaaccaatggcagaaagttggacaagatagtgcttgaaagcaaactggctaccgtgctgtatgcagttcagcacgacggcaaatacgttttcaagacccacgcagataattctacagcaaaaactccatatggagcatttgaggcggacgaaatagagaatgatattgtaaaagttctggagacactgcaggagtattaattctagaaagttttacctggaatacaaaaaataagacaaagaagggatagaaaaaattatgagaagattaggaaagagttacgaagaggcgcaggcatatacggatggagaaaagttgccggttggcggatatgttctcaaaattgagaacttaagatatgaggaaggggccaatgggaattcagatgtgattgtcttccaattcgatatagtcgaagggacttatgccggattcttccgaaagaattatgaagaaaatacgcaggaagatcgaaaatggaaaggaacttaccgtttatatgttccaaaagatgatggaagcgagagggatggctggaccgtcagaaagttcaaaacggtcatgaatgcctttgaggattccaatagtggatatcattggaactgggatgaaaacacattgaaagggaaggtgattggtggaatattcaatgaaaaagagtatgagttcaacggccgacacggcttctttacaaactgttatggtttctgcaatgttgagaaaatcagaagcgggaattataaagtgccagagccgactttgttgaagaatcgtccagccggtaccacctcttctgctaatgaagaatttataaatgtcccggaaggagcggaggaagccatcccgttttaacttatgaataattttgagatacagagctgccttgattctatggaaataatcgtggataccagagaacagccaacacagagagccagggcacgatatgcccaattctccgtgccatataaacgctgtacattggattatggagactatacctataactttaagctgccgggcggagaatggctgcatgggcttgctacaacgcttaaaccatgtgttgtagtggagcggaagatggatctgggagagctgagtcagaattttaccaggaacagaaggcggttcgaagaagagtttgaaaaagtgaaagcaatcggtggaagaatctatctgctggtggagaacgcctcctgggaaaatcttctgaatggaaaatataagagtcaattcaatcccaaagcttttacagcctctgttacagcgtatatggcccgctatggagctggggtgatattttgtaaggaggagagcagcggacggatcataaaggaaatcttgtaccgagagttaaaagagaggctggaaagaggggaatatgatggcggaaggctgggtaaaacttcacaggaaactgatggacaatgatttgtggaaagaaaagcccttctccagaggacaggcctgggtagatctgattatgctggcaagtcataaagacaaagaatttctgtttgacagcgcctatctgccaatctacaaaggtgaaatcatcaccagtaaacggaagctggggactcgctgggggtggtcaaattccaaggtagataagtttttatttgagctggaaaaagtgaaaatgctgtccgtaaaaagcgacacgaaaaagagcaccctgaaaattacaaattacgagcagtatcaaggctttgacagtatctacgaggttgagaaaacgacaggaaaggcgacacggaaacgtcagtcaaacgacacgcaggcgacaccgaagcgaacaatcaataatgtaaagaatataaagaatgaaaagaatataaagaaaaaagatattgcgcctgcggcgcttccttcggagatgacggaactgcagagagaggaactggagcttttgggatatctggtcggggagcgggagtatactgcggaggaactgcagaaaatggggtatgaatgatggtatacgagtttagtcgggaagatgcgtatcggtttcggagtcatgtgggaattcaggcaaaggaaaaggggaaggaactggagtttctattttgtccgtattgctatggcggaaagaaaaaggacaagtctactttttccattaacttaaataccggacagtttgagtgtaagcgagccagctgtcaggtgaagggaaatatgattacgctttcgaatgactttgacttctctctatccgaggatatggaccggtatctgaacagaaatgggtataacaaccggtttcgaagatttaaaaaggcacggatcacggttaaggatcgggcagttgaatatttacagaagcgcggaatctcggaacagacggttaagaaataccagattacagtgagaggagattctgaaaatatcctggtttttccgttcttcgatgagaagggagagctgcggtttattaaatacagaaagatggattttgataaggagatggatcgatccaaggagtggtgcgaagcgaactgtatgccgattctgtacggaatgaaccagtgcacggaccggaagaggcttgtgatcacggaaggccagattgacagcctttcgctcgtcgaggctgggataaagaatgcagtcagcgttcctaccggcgccaatggatttacctggattcctcactgctgggactgggtaaatcaatttgaggagattgtggtattcggggattacgagaacgggaatattacgctggtagatacgatacagagaagattttcccataagaaggtattggttgtctgggaagaggattataacggctgcaaggatgcaaatgagattttacagaagttcgggaggccatcggttgcatttgcggttgaacatgcgaggatgctgccggtaaagcagatcaaagaactggccgatgtggaagcggtggatatcgaggccatggagcacattaaaaccaatattcctgaagtagaccagctgattaatggcatgtatttgggccagctgattcttttgaccggaaaaaggggggagggaaagtcaaccttcatgagccagttagttgcagaagctctggagcaggaatataacacattcatttactcaggggaattggtggattttcattttaagaggtggctggatttacaggtggcaggaactcatttgaaataccagaggttggcaaacggaaaagaaacttactctatatcggatgcaaatatcaataaaattaattcctggtatcggggaagagcatttatctatgataattcagtaatcgatggagaggagttggaggatttacttaccgttacagagaccgctattaagcagtataatgtgaagtttatctgtattgataatcttatgacggcaatggaggtgacggccagagatgatttatatcgggctcagagcgtgtttgtcggaaagctgtccaagctggctaaggcttataatgttgtgattttgctggtagctcatccgagaaaagtgtctgggaatatttcaaacgatgatatcagcggcagcgcggatataacaaataaggttgacgtggtgatgtcctactccagagatgatggagacgatgatccggataaacgtctgttccgcgtaacaaagaatcgtttgactggacggctgacggaggaaaacaacccagttccattgtattatacttcctgcagcaagagaattgtcgggagcgataaggtgtttaatagggaatatgggtggagtacactggcagatggatttgatgaggtggaggatatcaatgcctatgtcagctttgattaggaggaaggatgacgaatgaagaggtatcagcggtcttgagagattgccagcagttctggatcagatggcggaatgatataccgtttccggaatcagacaaatggcaggagataacaaaggaggtcgcacagattatagaaaagtatggaaaatacaatgctgaaagagctgttgatggaatgttgaagcataaggaagaatatgtggcagggcctttagtgttttggtttcttgatgaagtggagcggcggagtaaagggatatctgagtcataatgaaaggaggctggagcggtggccaccgtaacgggatatcccggctcctttcaaagatggaaaagaaagaattaaccaccgaagagtggaaagcagagaagaagaaaaagaaagctcagatggcagccatgcaggcattgccttatgaggtaaaaataaaacgggcagaattacgcgcccatgagtttatcgacgaattgaaccggcgtggcctgaatgctcatgtaagcgtgggcgggttagacagtattgtattagacatattcctgcggagtatcgggattgatgtcccagccatatccgtatcatctctggaggataagagcattcagcgggtacatagagcactgggcattgaattcgtaaaaccggaaaaaagcaaggttcaggtacttaatgaggtcggtttcccggtgatcagtaagaagatagccggacggatcgatacacttcaacaccccacagaaaagaataagacggtccgccatgcgattattaccggagaatgcggggaacagggacattttgcgaagaacagccgtatgcagatgccgaagaagtggttgaaactgtttggaggttatgaaaacgagaatgagggagtgaattatcagattccagatttcccagtatccaataagtgctgcctgtatataaaagagcagccatgtgacaagtgggccaaagaacataatagccgtccattcttggggctaatggcatcagagggaggacagagggaagaggcactgacagatcatgggtgtaattattttgggaaaacagtaatccggagcgctccgttcacaccatttttgagacaggatatactaacgctggcaatagagatggatagatggtatcacgagcatctggatatttttgaaagagcattccatgaacaaccatatggacgaaatcatgacggtagcctgaaagaatatcaaccagtagaatccattattcctgaaatttatggaaccatagaaaagaatcaagatggagaattacatacaacgggagcacagagaacagggtgcagcatgtgtgggttcggtattcacatggaaaaacggcctcaccggttcgaccaactgcgagtgcgtaatccgaaggaatgggaattctggatgtaccgatgttgtacggatcagaagaccggtgagaaatatggctggggtcgagtattggattatatcggtgtagcctgggaagatgagtggaggccgggactcgtggaaaaaggaaaagagaagaaaaaagaaaaaatcatttgtagtttttgcggaaaagatattaagtacgaagaaccaatcaagataaaaacaaagcgtggaagcaaaatatgtcttcactgggattgctttaaatgtggactctaatacaacaaacgatcatttaaataataaaaggagttgatcaaatgttaaaacagatggatgagatggtatccggcctggcagatgcacggcgtaggaccaggcggatcatgagatattggggcagaactatagaaagggtcattgtagcgattacgatgccgatttgggcgattccgtattcgatatggaggaggcgccatggatagaaaagaagaacatgcaatggctcttcagtcggcacaggccagagcggcaaagcaggaatacatactgaaaggccccaggccagagacgcatagtgcgacgatgccggcctactgttataccgcaatgtgtccggatccggagctgcgggagccgatctggaggaggcacagacgtcaaccgagtatcagggccgcgaaggtagaaaggatctgccttatctgccggaagcgatggccggcggaatgtagccggaaaaattgtgattgtgagaggcaggggcatttgtatgcgattggaggttataatcatccgaggatagggggtggaaccagtggcaagacgtaaaatatatgcaatatacgaaaatggcgtgctactgggccactacgcaagcaaggaggcatctcttaaaatcggggtaccatgcgcaactatatcagcctatgcatcgagtggggctaagtgcctgggaagatatactatggaggtcgtaggggtatgtgataccgatgaggaggcgtggatagatgcatgggctgaggcgtgggatcaggtgagacaggagatattgacagcggggaggtgaggcagatggacaaagaagttctggagcagtacatagatgcctgtgagctgattaaggagactgaggcagatatccagagggtaaaaaaacagcgcaagacgatcattcaggattcggtcaaaggttccatgcatgatttcccttatgccgcacagagttttaagattcagggtatgacctattcagccgtaagagagccgggagcactggcagcgtatgagcatctgctggaggaacgcaaggcccaagcagaggaaatcaaaatacaggttgaggcatggctgaatacgattccacagcggatgcagcggataattaggttaagtatttttgagaaaaagtcatggggagaagtggctattagaatgggacgtaaagcaacagcggacagcgtcaggaaagaatatgagcgttttatagaaaataattaaagtttgtccgttttgtccacaatgtccgttttggaaatgttatagtatagactggaagatctgaaaaacggatttcctcccccaattgacggctgccggcttttaccggtcggtggttgatttatccttcataattcatgtttctcctttgactgagttcttacaaatatgtaagggctcttttgaataatacgtataatatgtattaaaatcattgacaatacgtgctacacgtgctataattataacataaggaggacagagatgaggttcagagaagtcgagaaaatgattttacaagatggctggtatgaagtaaaacaagttggttctcatcatcaatataaacattcaactaagagcggaaaagttacaataccagagcataaaggcaaagacattaatatgaccgttgtaaaatcaatacttaagcaggcggggctgtaaagcccccaatgcctgtgctaaaaaggaggaaaatcatgaaattagtttatccagcaatatttacaccttatgaagatggaagcggaggttatgccgttgagtttccggatctgcccggttgtgttactggtggagatgatatggcagaagcgatctttatggcagaagatgctgccagcggttgggtactcacagaactggaggacggcaagaaggcgcctaaagcgtcagagttcggaggcattaatacagagcctggccagtttgtgaatatggttgctttggatatggacacctatgctgaaaagtacggaagcaaggcggtaaagaagactcttacaattccggcatggctgaatacctacgtggaagaaaataatattagttgttcggctgttttgcaagatacgttaagtaaaatggcgcaggcgtcgatgcaataaattgtagaacctcattttgagcactcggttatatcgggtgctctttcctatggatatctggttattttaggctttgttgtaagatatgtgttttcttttggcataaaatgtgataaaattgcataatctatgggggaatgacaatgagatggaaggataagaaaaaactttttcagaaaaataaaatagttaagacaatgcgagccttacaacgcgcaaataaaaaaaaagcaagaaaacatcattgtaataaagatattatttatagtacggagactagtagaattttatgtgaaaaaaaattttatagcaagagtgtgtctgattatgtattgataaaaatgaatggtacagtactaataacgatacctaaggatttttctatatctaaaaatgcagatgaagtaatatatttattgaaaaagattttttattgtggcatgcaaccccaaattaaagagattatgtttgatcattctagatgcagtaaccttgggattgcggcaagtacgataatggatacaattgtgttagccgctaaatcttatcataaaacattaggcagtgacctgacaatatctgggaatttaccggaagatagatatacaaaagatgtatttattgctagtggtttagtgaagcatttaaatattaatcaatttactaaaaatgataatattattaaatttaaactgatttctggtagagcaggcgctcaagagtctgctcaagtggcaaccaaattgacaaattattttaacacgtgtcttcaaacgcaagggtataaattgacagatactggtgagaataaattagcatcgatgtttggggaagtaattgataattgtgaaagacatggaggtcgtagttcagtttggtatacattaggacattatcagattagagatgaatatgattggggggagattcaactaacaatatttaattttggagattcaatttatgaacgtttatgcggagcagatacaacaacagagacaaaaatgaagttacaaaaaatggtttctattcatgaacctttcttttcaaaagattggacaaaggaaatgatgtttagtgtcttttccttacaggagggaattagtagattaagagatagtaatcgagaagggtatagtaatcgaggaaaaggaaccataacattaatggatactttttatcatttagggcagacgaggaatgggataaagccagaattgacaattgtatctgggcatacatgtatacggttagataataagtatagactagaaaagaagagatacaatgatgaaatatttcaaaataaagaaagaagaattattgcgtttaataaagataatgatatttataaaaaggcagatagtaatgtagaactattaaaagatagttttccggggactgttattgctatgaaattttatctggataagaaatatttagattctgttatcaaggaggataaatgatggaaagtgaagtaattaaactacagtcttatcgaaaaagtgaatcaaggatgtattcaggaagagagcatggattagaaattagaaaagagttggacttaaacaagaaagacaaggatgaaaaaaagtatattatacagatatcggacgatacaattgctataaatagttcgttttttggtggattattttcagatagtgtagttggtttaggagaagaacggtttaaaaaaaagtatatatttcaaaacaataaaggcaaagaagtgaaagagactattaaaaaagatattgaagagggaatttatgatgctattaacggctagtccaagtaatgctttctggagtaatattgtaaataattcaggggctattgaggctattgctgctattctaaatatattattagtagtgtattttttccttagagataaacaagaatttagagatagagaaaaggagagaattaaagaacaagcatatgataaatggtataatttgttagtgcttgaaagaatgctggaaacactggatatattttttaaggatattgaatccgttgtttctagatctaagcaaggaaacggaatagaaatggtcgaattgatttctggaattaatgaaataaaaaatataatttcgcgaaataaaaggatatttattccgatattagcattatttagcgaagaattaaaacaagatgtttggaatacacttcaagaaagcaatgaccaaatattgagcgaatatgaacagtttatgtacggaaagcaatcaaaaaatacaatttatgagattattaatgaaacaaaaacaactacatataaaaaattatatgagtataatttgaaaaaattaagagaaatcattgaagatgagagaaagaactaagagatagccccggctgtctctttttctatacccaaaacaaacaaagagaaaaggctgcctattcggccgcctcatctctgcaaagttcgtccagggtaacgcccagggcatcggccagtttaatcatggttgatacccggccgtcgtcccgccgttccagatcttcgatggttcgctggggaacatctgccagctccgaaagagcacggagtgataaacctttgctgtttctgacttgtttaagtttcatagcaatacctcctaaaataagattagaattaggcctataacgactacgataagccatagaacagagaagacaagaatcagtaagtttttagcagtttttttcatgttgttttcagaatggaaatgtgttatattttagatggggaggtttccctccccgttgattaatggaagctttctacaatcattttaatgactgctaagaaagttccgatttccaaggcaagctgtgtaagtgctcgaaccacttttattagcttgcctatttgtttttccattctgaccacctcctttctatggtttaattataccacgtatatacgtgatagtcaagcataaaatgtatattttgtaaattttttcgcatctatcacaagtggtaggtgcttttatttaaccgaaaggaagtgagcctgatggcaaaaggaaaatacgaatactggttatcgcctgatggcttgcttttgctggaagcatacgccagagacggcttgacagatgagcagatagcgaagaatctggacataacgccatctacgctgtatgaatggaagcggcggtattcggagatttcggaggccctaaaaaagggaaaagaggttgtcgacattgaagtcgagaacgcacttcttaagcgggccctaggatattcctatgaggaaaagaaggtggaagtcagcgaagaggggacgaaggttactaaaaccatcaaagaggttgttccggatacaacggcacagatattctggttgaaaaaccggcgcccggaacagtggcgagataagcaggatattgagcacagcggtgccgtaaacgtccgcaaggtatacgatgaaatgagcgaggaggagctgatggagcttgcgaagaaatatgaaaaaatcaatagttcctgataagaatgcgctgattgagtatctgctgattcaacgtgcacttgctgttaagaaggccagaagagatttctggtctttttgttgtcttctatatccagaattctacaaagagagtcggccatacttgaaaaacctatgtcagacactacagggtttttacgaagataggattcagaagcagatactaataattaatatgccgccgcgacacggaaaaacatttacggcaaggctattcgttttgtgggtattcggccagagccctcgtactaagatcataactggatcgtacaatcagatcctttctggtttatttgcacagcagacacgagatggaattctgactgaaaatgaaggtgttaagcaagaatacttccacgatattttccctgatactgttattaagcagggagacgcagcaaaaggtttttggagtctggacggatcagaagagaagaattatctggcgacatctccaggtggtacatcaaccggtataggcgcgaattttgttattgtggatgatatcatcaaaaacaatgaagaggccgccaatgaactggtgaaggataagcactgggaatggtataacaacacattggtacagcgtatggagcgccccagaaagcagattctaatcatgacaagatgggcttccgacgatttggttggtagaacgctggagaagaaagcagataaatgccatctgataacatataaggcggtacaagacgatggttctatgttatgtgatgaaatcatgaccttagaagagtataagagtgtgatctcagagatgggcgcggatattgcctctgccaactatcagcaggagccgatcgacttgaagggcaggctgtacaccagctttaaaacatacagtggagaactgccgcagtttaaagagatccggaactatacagataccgctgataccggagacgactatctgtgcagcattgattatggagtaacatttgccagcgaggcttatattcttgaggtgctgtacaccaaagagccgatggaagtgacagagccagcgacggccgggatcctaaagaaagacatggtgaatgtggcggatatcgagtcgaacaatggtggccgcggctttgcccggaacgtggaacggattcttcagcaggaactgcacagcaatcacacgattgtcaggtggttcagccagaacaaaaacaaacaggcacgcatctattccaattcctcttgggtgatgcagcatatttactacccggaagactggagaaatcgctggccggagtattacgacgctatggtgaaatatcagagagagggtaaaaataagcatgatgatgccccagatgccactacgggtattgctgagaagatcggcgccggtagtgcatttagtttcgagtaggaaagaaggtgagaagattgttaattgaatatggcagtgagacacggcgaatcaacgcaattgtgaacgcaggagccagaactatgatgggagatatacgttttctggagaaggaaatacagaagtggaaacagtctcctgtgcgtaagacaatgatgcttgcggaacgatattaccagggggatcatgatatacttcatacgtcacgaaaagccattaacgagaagggagagctggagccggtcagtaatcttccagataaccggatcgtagataaccagtaccagaaggcggttgatcagaagaaaaactatctgctgtcaaagccttttacaattacgactgaaaacgacgcttatacagaagccttaaaggatattctggataagcgtttcatgcgttccctaaaacgtgtggccggtgactctatcaatggcggcattggttatctgtatccatattacaatacagaggggaggctgtgtttcaaacggtttaataattacgagattatcccgttttgggctgatgaggagcacacggagctggattgctttgggcgtctgtatcaaattgatggctatgagggagagactgaaaagacatatgagtttttcgaactgtactctaaagatggcgttgaacgatatcaattagatggagcgcatctgattcccgatgtgatgcacccgtccggcgcccattacctggtggaacagcacgacccggacggaaagcatgtggaagtaccttataactgggagcgagtaccactgattccatttaagcgcaacgcccatgaaataccgctgatccggtgctgcaagagtcttcaggacgggatcaatctgatggtgagcagctttgagaataacatgtgtgaggacgccagaaacacgatcctgattcttgtcaattacgatggtcagaatctgggagagttccgtaagaatctttcccagtatggagcggttaaggttcggaatgatggaagcggatcgggcggagacgtgaaaactttgacggtagaagtgaacgcagaaaactataaagcgattctggagattttcaaacaggcgctaatcgagaactgtaaatcctatgatgcaaaagataaccggctgacaggtgatgccaatcagatgcatatacagacgatctatcaggatatcgagttagacgcgcaggatatggaaacggaatatcaggcagcctttgaagacctgttctggtttgtggatcagtatctgatgaattctggaggcggggacttcgaggcgatagaggtagatatcacattcaaccgaaacatactggtgaacgagacggaactgattgataattgtatgaagtccgtcggattccttccgacaaagctgattctgcaaaaacacccatgggtggacgatgtggaggaggctatgaaactactggaggaggaagaacaaaagaaaatggagcagatggatccttaccagaaggctttcgggcagaaaaagcctggaaaggaactggaaggcggtgataacctgaatggcgagacagaatagtgcttactggcagaaacgaatggaggccctggaagataagcagtatcagaatggcgcggagtattacaaggacgtccaaaagcagttcagggaagcatcaaacaatgttcaggtggacattgaacgatggtaccagcgtctggccgacaataacaatcttagttatgcaggagcaaaaaagctgcttaagaaggacgaactggacgagtttcactggtctgtagaacagtacataaaggcaggggaagagaacgcagtggatcagaggtggctgaaggaactggaaaatgcatcagcccgccaccatatctcttatctggaggccatgaagcttcagactcagcagcacgcagagctactatctacagagtttgaaggaggcatgacagagtttcttcataaatcctatggtgatcagtattaccataccgcgtttgagattgccaaaggtaccggcctgggaagcaatatggcccagatcgacagccgaaccatagatactctgattaaaaagccctgggcccaggacggaaagaacttctcagaccggatctggacgaataaggataaactggtaaacaatttgcatacagaactgactcaaagtattattcgaggcgctgatctgaagcaggccatagacaatctggcgaagacgatggaggtaagcaaggcccaggcagggcgtcttatcatgacggaatcagcggcgatatcagcggcggcacagaaaaactgttttaaggatctggatgtggaaaggtatgagatactggccacactggacagtcatacatcggatatctgccaggagatggacggtaaggtctttgagatgaaggattatgaagtggggacaaccgcgccgccgtttcatcccaattgccgttctaccacgatcccgtatttcgatgatgagtttacagaaggggaagagcgggcagccagagatgaggataccgggaagacgtattatgtgccggcggatatgaagtatgaagagtggaaaaaagagtttgtggaggaacctgttaagaaagaaaagaaagaaaagagtgataaactgggtacaggaaaaagtaattcatccagcgaaacgcaaaggatcgagatcggcagcgtgaatgtcgaaatgagggaagaagccatttcctattttgaagaaagtatccgtcatgtgtcggttgaaaatgctgtcgtaatagacagtgctggagaagttgttcagtttattgggcagaaagacagtgttgatatatttgatgtaaatttgaaagatgccattgtaacgcataatcacccagaatcagaaggtgtcatatcgtttggggaagatgattttaactttttgcgggaacatcaagacttaaaagaatttcgatgtgctaacgcagaatataattatcgaattgtggtattgaaagatatggctgaagttgtgtataatgatatctatacagagggattcaaatattttggagatccggaatttgaagcacaggatgctgcaatgagggtacttcaggaaaggggatatgttacctatgaaagaaatcgagttgacacccgaacagagaagtaagtacaatgaattattagcagagatgcgggcggaattagaattattgccaaaatccgatggtaatatattatcatgtacagttgggaataggccatatcaagaaataagccagaaatatctgccgaagttaaaggaaattctgaaagagtaaataccaccagtcaataaaaagaccggtggtatttttatacccatttgccagcagatcaggcgtaaaacagtcggcttaacttgcaatcatgcggagataccgcgtaataaatcgtagaggagaggtaagatgaaacggaagtttttagaggatttgggactggagaaagaagccattgataagatcatggcagagaatggcaacgacgtgaatgcagcgaaagcagagtatgattccatgaagcaggagcgggacaccatggcggcccaggtggcagagcgtgataagcagctggaaacgctgaaaaactccaccggagatatggaagcgctgaaacagcagatcattacacttcaggcggataatcaggcagccaaagagaagtacgatgccgatatgaaggaactgaagctttccacagcgatcaggctggctcttggtgaatcggcccaggacagcgatttagtcgccgggctgtttgataagtcgaagctgatcttatccgatgacgggaaggtaacggggcttgaagaacagttaaagtcactgaaaaaggaaaaagcttttctgttcaaggaagagaagccggcgcaggtccagatcaaaggcgggaagcctgcggagggtgccgggacaccgccagcagataagaaaccattagaaatgacctacagtgagatgtgcaaatacctggaaacgaacccaggcgctgcaatcgagtaaaagaaaggaagagataagacatggcaaaatttaacgagaaaacatttaactcggaagcatttggaaagtatgtggaccggattcccaaaacaaaaagaaatgaactgattaagtcgagggccattaagggaaacgaacagatcagacaggcgttcagctcccagacaggtacttcttacgcaacattaccgatgaagggactgctggaaggggcaccgctcaactatgatggaaagacggatatcacgtctgagagaaccacaacctttgagcgaagtgtggtagtatggggacggtccaaagcatggacagaggacgatttctccactgatattaccggtggcgtagattttatggataatgtggcacagcaggtatccggctggtgggatgatgtgtatcaggatgtgcttctggcagtactgaagggtatctttgcaatgacaggcacaaagaatgtggagtttgtcaacgggcatacttatgatattacagcggtgaccggtgaagataaggacgggaatgcattaagctgcgtaggcccgacaaccttaaatacagcaatccagaaagcttccggtgataacaaatcaaagttcacgattgcgatcatgcactccaccgtcgcgaccaacctggagaacctgcggcttctgtcctacatgaagtataccgatgctgacggaattcagcgtgaccttgcaatcggtacatggaatggccgggcggtaatcattgatgattccatgccggtagaacatgtagacgcagtggaagagagcggaacgtctggaacagaaggctatgtgccggcagcgccagcttatgaaaaatacaccacatacgttttgggagacggtgcgattgatttcgagaagatcggcgcagaggttccgaacgagatgcagcgtgatccgaagacaaacggcggagaaaccacactgtatacccgtgaccgtgcctgctatgctccgtacggcatttcctacacaaagaaaactcaggcgtccttatcaccgacaaatgaggaactggctaatggcggaaactggactctggttaataacggcggcaccggtcagggattaaaggtcatcgatcataaagccatcccgattgcccgtatcatttccagaggttaagcctatggaggcagggaagttaaaggggctgctgggaataccggaaggcgatacttcccaggacctctcactggaattcatcattgacgatgtaacggaaactattttgaattactgcaatctggaggaactgccggcaggattaaccaacacggcttaccgcatggcgattgatctttacaggtatgatcagccaggtgctcccggcgtaccggtgactgtggcctccatatcagaaggagatacttccacaagttttaccagcgcggctgatgccttaaatggcggcctgctaaaggactatcaggggcagtttaaccggtaccggaaactgaggtggtaagatgataacggatgcgatcagacaggctcagataatgcacagggccgccatagaggcaacctataacggttcctgcaatatttataacagggagccgaaaagagacccggaaacgggagtgacggcgctggaagatgtttgcaagcttgagaatcaattgtgtcacctctccttttcaagttcggtcccagcggcagagaccggcacagttaccaatgtcacgcaaaccattaaactgtttctggcaccggaaattgtcattgccccaggcagtaaaatcgaagtgacacagcacgggcggacagaggtgtacgggcagagcggcaaggcggctgtgcactcttcccatcaggagatactcctggaattatggaaggggtatgcgtaatggcaaaatggggggattttgatttcgaggatttaaagaagctgcaaaagcaggtggaacagatcgagaaggggcgggaggaattctgccggaaatgcgcgaacgaactggcggcccgactgctccgaatggtgaagcagagaacgcccgtgggaatctacaatgcaaaaacggtggaattcctagcacatctgccggaacggaaagtagagtttaatacaaagtcaggaaagcacgtgagctttactgcaaaagccaaggtgaagaaagtgaagtttactcctaaatcttccggaaagacgggcggtactctgcgccgcggttggaccataggggagataaggcacaatggagacctgtacgaaattgaaattatcaatccaatcatgtatgcacagtatgttgaatacggacaccggacggcaaaccataaaggctgggtaaaaggaaagttcatgcttacaatctcggaacagaagatacaggagattgcaccggctcttctggaaaagaaactcaatgaatacttgagggggtgtcttgatgtataacgagatcatggacgcagtgacaaagcagttatccgcgctgttcccaccggaagccgggtacacagtctatacagatgcggtagaacagggactttcggaaccctgtttttttgtacagtttttggagccttctgagaagccgatgatcgggacacgatattaccgtaagaatgccatgtgtattcaattcctgccgggagacatagtaaagccttctcgtgaacttaaccgggtattggatatcttaatggagcagatgctcaggatcgaattgaaaagtggccggaagataaacggctcagaccggagcggtcgtattgacggaggtgttttgttatttcttgttcagtacaataccttcgaagcacgggagacgcaggcgggcaaggaatctatgacagggattcagattaatgaaatgaggtgacgacatggcaagaagaaaagaaaccgagcgcgcagaagcgaaagcagtagtgcacgaggcttgtcagtacacaaaggagcagctggctggatccgattatttccggccgcggcgggatctggtagaggctttgctaacaagcggacgtaagtatacgataagcgaagcagagcaggtaattaaggaatttttgaaaggaaaggtgagtttatgttaggtggtggtagctttaccgcgcagaataaggtacttcccggcgcgtatattaattttgtcaatgcagcttcggcggcgtccatgatgggtacaagaggtacggtagcggtgccgatggtccttgattggggaacggagaaaaacgtgattgaaatgacggcagaggatttttctaaaaacagcctggaagtatttggctattcttacgatgaccccaaaatgctcccggtacgtgagctgtttcgaaatatgacgaaaggcattttttaccgcctgaatggtggtgcgaaggcttctaatgatttttgtactgcgaaatacagcggagaaagaggcaatagccttatgactgtgatttcgaagcatgtagatgatgaaagcaagtttgacgtcataacgcttttaggtggaaaagaaatagagatccagaccgttacagcggcaacggagctgaaagaaaatcgttacgtttctttcaagaaggatgctactctggcagaaacagctgggacgtcgctgaccggaggcagcaacggggacgaagtatccggggaagaatattctggctttcttgagaaaatcgagagtcgttccttccagatcctgtgctgccctgcaaaagaagaacaggtaaaggcattgttttcggcttttactaagagaatgagagaagaaaacgggattaagttccagacggtggtgcatcagtataccgcggccgattatgaaggtgttatttctgtggagaatgaggctgcagaggattcggccgggcttgtctactgggtagccggtgcggaggctgcctgcgcagtgaataagacggtcgaaaacatggtatatgatggcgagtacaccgtgaaggccgaatacactcagctgcagcttacagacgggatcaaggcgggaaaattattctttcacaaggtgggagatgaaatcagggtgttaatggatattaataccttagtgaactataccgacgagaaaggcgaagatttctcaaacaatcagaccgtgcgtgttttggatcagatagggaatgatattgcagcaatatttaacaaccggtatttgggtaagatcccaaatgatgatgcaggccgggtaagtctgtggaacgacattgtgtcttacgtgaaacagatggctggaatacgtgctattgaggctgtggagtctaaaaagatcaaggtggagaagggacagacaaaacggtcggttgtcgtgaatcttccggtggagccgattaactgcatgagtcagctgtacatgactgtggtggttcagtagaaaggagcattgagaaatgttaaataatccgattatgaatgcaaaggacgcaatcagcgcgtcgcttgcggagtgctttgtcacaattgaggggaaccggtataattttatgcaggcgatcaatttggaggccagcattgagaagacgaaatcagaaattccaattctgggaaagacggggaaaggtaataagacaacaggctggaaaggaagcggatcagccaccttccattataacaccagtatcttccggcagcttctgtatcggtataaggagacgggagaggacgtgtattttgatattcaggtcacaaacgaggacccgacagccggagtgggacgccagactgttattttgaaagactgtaaccttgatggtggcattctaacaaagtttgacgcagatgcggagtatctggatgaggatgcagattttaccttcgaggattttgaaattccagagacatttggtgacctcaccggtatgcagtaaaagaaagagaggataagcaattatgggagatttaagcagatttttaaagaagaataaaaagacgaaagagaacattaagattccggcaacgatgtctttaacggatgagaacggaactcctttattgtgggaggttaagccgattactacaaaagaggataacgctatccgtgaggcatgtactgttgacgttccagtgacaggcaagccgggaatgttccgccccaaatttgatggtaacaaataccttgcaaaaatggcggcgtcctgcatcgtattccccaatttaaatgataaggaattgcaggattcttacggagtcatgggagcggagcagctgatcaccgagatgatcgacgatccgggcgagtacaatgatttcatgaaccgggtccaggagtatcatggttttaaagaaacatttcaggacaaggtagaagaagcaaaaaactaatcgagggagacagcctggaggcgaatatcgcatactactgtctccacaaactccacaaatggccgcatgagtatctggaacttgacgagatggagcaagcttatgtggccgctgcggtggagattaaaattaaaaatgataaagaggctgagaagaagtcaaaacaaaagagcaaagggaaaagacggtagattctggaataataatatggtatgatatgctcaaaagagaaaggagcgtgtaccatgggattgtttggaaaaaagtcagaagtaataaaagaatttagagttgtttattatgaaggtagtttacctggtataatttcagatgatgcactgaaaatatctgctgagggggaattcctcgttattgacgatttagctaaccataatcaagtaaagctaagactggataaaatatatggaatagagatatatacagaaaaaacatacatggaaaaatataaagggaatgcccctttaactggcgggaaaaaagatttttatgtgtttcattatttgacaaaagataatatagaaaagcgctttgatttatgtgacgtttcagctaaaacaatgggggagatagctaaattggtcaaaattgttcaaaagaacgctaaacctaagacttatgaaatttgatatttggcaccttgagtaatcagggtgcttttaatttgtgtaaaaagggggtgaatggatgtctgttagctcaacattacaaataaatgaccgcatgacacctgcgttacagtcaataacaacggccataaatatgatggtaagcagtttttcggcagcacagaccgcatctgaaacagctgttaatagcgctcaatggaatgcagcaacacaagcagtacaggcagcttcagcagcggttgaagaatatcaacaggaattagaatctgtacaaaataggccggttacagttccagagccgtcatggagcagtgttgtgacagcgcagacgccttctgtctctggaactgaacaatttcagcaggaatatcaggccgcaactgtggcggctcaacaattgtaccagactcaacaggcaatttctgcacaggcacgtaatatgactgtgacgcctccgggaatgcttaatgatgtggcggcagtggaaaaccgtatgcaggcgctttccttgcgtgtacaggagattaataacattcctattgatatgcgtactgataaagtcaatcaggaattggtgacgttgaatggtcaattgagtcaggcaacctctattcagggagacttaagcgatgccatgtcccatatggatatcagcgctgctaatgcagcatatagacagctcgtctctgttatggatactgcggaagtaaatataaaggataatatagttgcgcaggaacagtttaacagatcaatcaccgaagggaaaagcgccgccactgctctcggaagcaaaataaagcagtttgttggcatgtatttaggagttcaaggcataaaaatggccgtcaattttgtcggtgatactacatcattacaaaatatccagacagaagccgaaacaaaattaggggcagttatgcggcagcgtatgggggctactcctgaaatgatacagagcattaaagacttgacatctgcacagcaacaattgggtgttgttggtgatgaggtacagttatccggtgcacagcagttatctacttttttaactacagataccgctttaagcactttgatacctgcaatgaataatctggcagtgcaacaaaatggcgtaaatgtaagttcccaggatatggtcaatatcggtaatatgatgggaaaagttatgcaggggcaggttggagcacttaccagagtgggtgttacatttgatgcagctcaggaaaaagcattaaaatatggaaacgaacaggaacgcgctgccacgctggccgaggttatcaccaataatgtaagcgaaatgaattcgatcatggcggccaccccgcaaggccaaatacagcagatggcaaacacatggggggacattaaagaagttgttggaggaaaattatatcccgcagttatgagcttttttacagcagtaaatacaaatatgccacgagctgaaagtgttataatgggggtagctggggggcttaatctgctaataacgggatttggatatattatagattttgcgggtaatgcggctggagtcattcaagataactggtcgtggatcgctccaattattgggggcgtaacagctgcggtaatagcttataatgtggctatgggaatcggtacaattataaccggaattgatgctttggcaaaaggtgtgcaaggggcggctacaatgcttgcaacgggaaaaactattgcatatacagcgtcgcaatacggtcttaatgctgcattgcttgcttgtcctatcacgtggatagtaggagctattctgctttttgttgctgctatctatattgttatcggggcaatcaacaaatttaaaggcacgtctataagtgctaccggtgtagtggcggcaatatttggaacgcttgcagcacatattgttaatacgtttattgtcccgacatggaatggaatagctgctttcatcaactttttttataatgtctggaatgatccggtagcatcagtaaaaatattattttatgatttagcatctacagtaatcggctacattgtcaatatggctcatgcaattgaggatgtaatcaataagatacctggtgtacaggtgagtatcacagcgggccttgataatttccaaaaccagataaaatcggcggcacaagaagcaaaagacgcgtcgggctggaaggagattgttggatcgatgtcatatattgattattcggataatgcaagtaagtggtatgacaaaggggctgcgggtgaagcggcgttaaaggatattatgagcggaggtaccgcattcaatatcgaatcagagtccgcagcacaaacagccttaaacacaggaagcacagcgggcaacaccgcgaaaatagctgatgccatggatgttatggacgaagatttaaaatatatgcgtgatgctgcggaacaggagattataaaccgtttcaccctggccgaactgaaggtagacgttaaaaatagcaacacacttacaaagaaagcagattttgatgatatgggaagttttctttccacttttaccagcgagtttctcagtgcatctgcggaagggggacatatttaatggcatacgaagtatatattgatgatatgttactgccgcttccaccacaaaagataccgatcaaatacccgggtcagaataaaagtactaccctgattaatggggaggaaattaatctgatccggccgtcgggtcttgctgaaatcacaattgatgtagtcataccgcagatgaattatccgagtgctgtatgggatggaagtattgtcgatgcagaggactttcttgaccatcttcacgatctgaaggagagcggggaatcgtttgaatttattgtaatccgggacggccccggcagaaatgatttctttgacaccaatattgatgtaaccctcgaggattataaaatatcggacgatgtgaaagagggattagacctggttgtatcactgaccatgaaggagtataaaagctacgggacaaagatcatgaattttgtgattgtggaagaccagcctgtaccggcggccgaggagccggagccggagcgggagggatcgccgccggctgcagagacttatactgtgcagaaaggggactgcctctggaacattgcaaaaaagaagctggggaatggcagccgctggcaggaaatttacaatctcaaccgtgacaaaatcagcaatccgaacctgatccagcccgggtgggttctcacaatgccggcataggaggcagcgcagatggaagtacatttatacattcagaatggccagaccgtgtatgagcctgtagtacagggaagcatcacatgggagactgaacggaaagggcagccagggaaatgctcctttacaatcattccggacagtacattaaagattgaggaagggaatgccctgcgactggacgtatctggtaagcctgtattcttcgggttcatctttgaaagaagctggaacagtgacggcatcatgaaagtgacggcatatgaccagctccggtatctgaaaaataaggatagttacaattatgacaaattgacagtcggtgaagtgatccagatgatcgccagggattttaaccttcaaactggcacgcttgccgatacgggatatctgctttccagaaatgaaaaagacagcacactttttgacattatcttaaacgccctggatttaaccatgatctataccggaaaaatctatgttctctatgatgatgtgggaaagctgatactggaaaatgtagaagatatgaagctggacatcgtgattaatggcgaaacagctcaggactatgactacaaaatcagtatagacagcaatacctataatcagatcaggctgtattacgacaacagcaatacaaagaagcgtgagacctacatggtgaaggacacagaaaccattaataagtggggcgtactccagatgaatgaatccatagataaaggcgttgatggccagactgtagtggagaattacttaaagctttacaaccagccgtcaaagagcctgaccatcaaagatgccttcggagatgtccgggtgcgtgccggctgtctgattccggtatttctggatattaaggatatgcagttaaaaaactatctgctgattgaatctgtcacccacaagattgatgaaggtgtgcacaccatggatttaaaactgaaaggagctggaatcaatggctgatgctgaatggattggaaatatcagaaaaatagtacttcaggccatagaagcgggaaatccctgtgatgtagttttcgggacagtggcgaaatcggcgcctctggagatccagataggccccaaaacatttttgcagccatatcaactgatccttccgcagggtctgacagaccatactgaggaaatgagtataccagaaattggaactgtaaatgccactgttaaaaatgcattgaaggcgggagagcaggtgctgttaattcagaagtggggcggccagcagtacctggtggtggaccgctggcaggaaggaggctgacatgctgccggagactggaaacattttaaagcaggactttgaaatccgccagattccttctaaaacctacaggctggttacggcaggcgcttctggctggacggagggggcggacgcagcgggtatttccgcaaatacggaggggctggaagtaaaaggggtttcgggaaagacagacggactggaagcggtaaaacagtccgttttttgtatccttcatacggagcggtttgactggctgatttacagctggaattatggcgtggaactaaatgaattgttcggtaagtctccgggtgttgtgaaatcgaagttaaaaaagaggatacgggaagcattgacgcaggacgacagaatcgtaagcgttgatgctttttctttttccgtgtccggaagtaggctgcatgtctctttttgcgttcatacgaaattcggtgtcatggaagccggaacggaggtagaaatctgatgtacggggatatcagttatgaggtcattttaaaacgaatgatggagcgggcgccggctggggtggataaaagggagggatctattttatatgatgccatggcaccggctgctgcggagatacagaacacctatattgaactgggctgggcgctggaacagatattcgcagatacagcaatccgggaatatttggtaaagcgctgcaaggaatggggagttgtgccttatccggcaactaaggcttcattaaagggcgagtttaatatggaaatcgctttaggggaacgtttttcccttggcacattgaattacacggtggtagaaaaaatcggtgataaaatctaccaactggagtgtgaaacacctggaactgccggaaaccgaaaccttggggtcctgatcccgatcaattacattcagggactgacccatgcggaattgacagaagtactcaaagaaggttcggaagaggaatcaacggaagcactccgggaacggttccttttcaaagttcagaagccatctaccagtggaaatatctatgattactataactggacgatagaatgtgccggggtaggtgctgctaagatatatcctctggccctggggcccggtactgtaaaagtggtgattgctgatgcagagagatcggcagcaacgccggaactgatcgagcaggtaaagaaccatatcgaagagctccgcccgatcggtgccgatgtctctgttgtttccgccagagaaaaagcaattgccgtgacggccagagtcaggctgcagaatggtgtgaacctgggaagtgtccaggaaatgcttatgctggagcttacgaacttcttacaggagggggcctttgatgtatcttatgttagcctggcgaaagtcggaaatctgctgctgaatacaactggggtggaagactttacagagctgcggctgaatgggcagggagctaatgtcagcttggcagatgaggagatcgcagtggccggagcagtcgcgctggaggtgatgcagtagtgaaaatcagtacttatacggaaaaactgaataaagtggacggtaatgtatacgtgatcgaagaagaggtatccttagctgatggcgtatatgaggcccctctggcgcatgataatgtcaatccttctacgctggccgtctacaccgggcccaagctgaccggggagcggatccagtcgtatgcgctgtctacgcccagcctgatgccatggaagcggctgatccgtatttataccgatgtccccaccgtctatatcagctatgagacggatggggatacggtggaggcggaagacgtgaatctgcttcagcaggacgtaatacggacccaagaggggcttaacgaggagaaagaccgggcggaggcagaagaggcccttttgaaggaagcacttgcagaggaaacggcaagggcggaggcgacggaaaagaaactgatggtggatcttactgcggagattggcagagcgaaggcggcagaaaagaaagtggctgcggatttaggaaaagaggtggaccgggccacggctgcggagaagcacttaacggacagtttggtggaagagaccacacgagcaactatggctgaaaaagttctgacggataacctttctgccgaagttatcagggcaaaagccggagaaaagactgtggcggacaatctggcagcagaaacagccagggcaaagacgagggaagatggaattgctgcagaacttgccgctgagaatatcagggcattgaatgccgagaatgcgctggctgaagacctgactattgagacaatacgggcaatggcggtagaaaagaccttcaccgataatttggcgggtgaaacagccagggcggaagcaaaagaaacggagatcagcgagaatctttcttctgaggttacaagggcgaaggcggcagaaaagactctgactgataacattacggtagaagtgaccagggcaaaggacgcagaaaagactctgactgataacctggcagcggaaaccatgcgtgcggacaataaggagcaagagatcattcgtgaactgacggcggagagtaccagggcccaggcaacggaaacggtgcttacgaataatctgtcagcagaggcgacccgggcaaaggcagccgagaagacaaatgcagataatcttacggcagagaccagccgtgccaaagcgaaagagacggagcttcagggagatattcagtcggaggcttccagagcagaggcggtagaggccgcgatcaggagtacaatatcaaccaacaagcccatatgggatgataagtatacacgcaatgagatagataacaaattttctgctatggagacggccctcgattggaaagaggcggttaataccttcgcggatctggcgaccacgtatccaaatccggaggacggctggacagtcaatgtgaagaatacggactatacttaccggtggagcggcacggcgtggattgccatctcagctaacgcgatcccaaaagcgacccagagtgtggacggactcctttccaaagaggataaagcggctcttgatgatacgaacgcaaagaagcatacccacagtaataagtctacgctggataagatgacggaggtgctgctggcaaactggactgatgcctataataaacggcacgagcacgggaacaagaccgtattagataagatcacccaggcactgattgataactggaccgcggcctatacccacatcagcgacgcgccaaagcatatcacagcgacggagcggacaaactggaacgatgcgaacagtaaaaagcacacccatgcaaataagagtatcatcgataagctcacccaggccatgcttgataaattggcagggattgcaaccggagccgaagtgaatgttcagtctgattggagcgcaacggattctgcgtccgacgcatttattaaaaataagccgacctccatgactgcaaagggtggtgagtctgatacggctgttaagttaaaaactgcgcgtacaattaatgggattgcatttgatggctcaaagaatattacgatagaagctaatactccgataaagcaacttaccagtggttcacttgatgatgtaaaaacttttggggattattatgctgccggcggaaattctgtaactggaaaaccggaaagcgtagatcattttgggctgtgtgttttacgtgtagcaagtggatatattggacaagaactcgatgttaatggtcggaaatggacgcgaatgtacaacagtagtacgagtgcttggagtggttgggtagagtttttctcagaagggcataaaccggcatggagtgatgtaaccggaaagcccagtacctttgttccggcggcgcactcacatacaaaaagtcagatatcagactttccctcttccatgcctgcatccgatgtagcagcatgggcgaaagctacgacgaagccttcctatgggtggactgagataactggtaagccgagtacttttgcgccgtcagctcatactcatacgaaaagccagatcacggatatgccgactaaggtgtctcaatttacaaatgatactggatatattactgctgctgatgtcgataccagtcagaatcatgttcatgcgaataagagtgtgctggataagataacgcaagctctcctggataattggaatgcagcacatacccatgtaagtgacacggtaaagcatatcacgggagttgagcgaacaaattggaatgatgcaaatggtaaaaagcatactcacggtaataagagcattttggacggaatcacacaagctttagttgataaatggaacagtgctttgactgcattgcctgctcatacccatacaaaatcacagataactgactttccagcatcacttccagcaaatggaggtactgcaaattatgcaaattacttgaatgttaataatatagcggctaatacagatcttaatacaattacaacaccgggatattattactgtcctatgagcgcaactgtaacaacatttaaaaatagcccaacatcaatggcttttttcatggaagtaggaaaacacgctggggtataccagaagattgtggagtacactgtcagtaatccgaaaacatatgaaaggaattattatagtgattcatggggaacatggaaaaatatcactgttctaactcctgttccagctggcgcaaaattcacagacacggtttatacacatccagcaacagccggtaataaacatattcctgccggcggagcttccgggcaattcctgaaatggtctgccgatggtactgcggtatgggcggcagataataatactacgtattcgacatttaaggcagcaacggccaacgccgcaggcggaacgggtctggttccggctcccgccgcaggagcacaggcaaagtatttaagggcggatggaacatggcagacacccacagatacgacttatagtgatatgaagggggcaacggccagcgccgcaggtacgcatggacttgtgccagcgccagttgcaggggcgcagggaaagtactttagagctgacggaacctggcaaacaccaccggatacgaatactacttatagcgcggctactcaaacagcagctggtcttatgccggcggccgataaaaagaaattagatggtgtagcagctggggccaataattatgttcatccttctacacactctgccagtatgattacacaagacgccactcaccggtttacctcggatacagaaaaaaatggatggaataagttattgttttcggcggccatcacagttcctgcttccggctggagcgcaggggcgccttacacccagaccgtgtctgtttctggtttgacttctgctatggatgtcatgctgacgttgaatattaccggcagtcctactactaatcaggtaaaggcatggaaagcagcgttaggcatgattgatgtcggaacaaccaccgatggatcggtggtatttacgtgttacagtaagaaaccggccgttgacctgccactatacataaaaagcgtttaggaggagcatatgtacggaaatacattatatggtcttgcaaaatatgcacgggaggcggaggacagctatacgccggaagaatattttgtggacctggcccgatacgtaccgccattcctggcagagctgcgggagctttccgccctttatgagacagaagggtacgaaattggatatctcgaacataatctaagggatttgtttgaccagtgctttattacaacggcaacctgggggctggtgctgtgggaacggatgtatggagtaaccacaaatatgtctttatcctatgagcaacgccgggagattttgatggcaaagctgcggggacagagtacgacgacaaagcagatgatagaggatacggcggcagcattctcaggcggagaagtacaggtaattgaagataatccccatcatcattttattgtgcgctttgttggtgtcaaaggaattcccagaaacatgcaggcatttattgatatgttggaggatattaaaccggctcatctgtcctatagctttgaatatacctataccgtatggggcaatttgaagggactaacttggggagatttaaaggcacagacctggggagagataagaatcatggaaggagtataagcagatgcagacaacacagaattacagcttgaagaagccggaagaaactgatgtgattaccatcagcgacttgaatgataatatggatatcatagatgaagttatgaagaagtttgtaaaccgacggattttgaagcttatggccgcaggctggagcggttcttacccgttcactcaggcagtagacgctgcagggatagccgtggctgatgatatcaaggtgatgggagtttacattccggcgaatgccacattagaacaggtgaaagcctggaacaaggcggcagggtatctgatgtgtaatccggatggggtggcagatgggaaaataatctttaaggcatataagaaaccgacagtagattttcagattttgacagaaggagcatgagacgatgggaaaagtaataccgatgctgggcggaggcggcggagcggatctggatgtgattaccgcgacggcggctgatgtgcgggcgggaaaagtaattgttgataaagaaggcaattcgcttactgggacggagcctgagcggggaaactggaccggaagtgtggcaatgaatggaaagatcacgatacctgatggtcatcacgggggaggcggatatgtcaacggcccggcagttacccagagaggcgcctggaacggatccgtaggaatgaatacgcaggtggcaatcccggaaggatatcataatggtgcaggaaaagtatcaggtccttccgttgcttaccagaatgcagatgtatcgggcaccgatcgggctaatgcaactaaccggtcatgctgggacggtacgatttgcttaggggtgcgcaataatcattatttaaacggggtaaattggattcagtatagcgatccaaatttcaaagcttcgaactttaaaaagggcgttcctataatgggccttatcggaacctttgaggggtatgttccgacccctcaagacctgtatttaagggggaacaatttatatgggtggtatgcacagtcaggctccagaattgattcaggtcaaattactataaccaatacaacatggcagataagaaatactaacagtgttaatctgacaggatataacaatcttaacttttgcggatattcagatcgtcccaataatgcagtgtctgttgaattaggacaattttttaatagtcagtattggaataccattgtttctttgggatccatacatattccgcaaggtgattacacaatttcttttaatatacaaaatattaatagctcaggaactttaataattggtggaaaagtgtttattaataacatatatcgaatctggttgtcttaacttagccagattcggtagatgtaacctctccaacgctgaaaagtaattgccatgctgccgcttatattaagtgcgcttatatctatggagactgtctgctgtacattcaaagcgctgtccagatccactctggctgagagatcgccatccgtatgttgtatagtaattgaatgatatgggttactccccagccagccagttttgtaaagctcaaaattaagacgattgtaccctataagtgaaaaattcgccatcatagcgtgctgttcgtttgcagccgtcaatgttagctgtccagcgtcaaaagcaggaaaaccgtaattagtgtatctcgtaaagttagcaatgtttttgccccttaaatacaggtcttgaggggtcggaacatacccctcaaaggttccgataaggcccagaatcggcattataggaactaagacagccagatgcggtaaatagctgctggtttactttcgtaagccattccatatgttgcgattccaactcttgcagatatttgagcactagaaatatctactgataccgtatgatttcctatcgtattcgggtactcagctgacgctattgtatagccagaagatccgagggtactaattgaaatttctggttggtatctgtagacaatacctcgataaaattctatgttgaatcggctataacctacaaaatttatagtaccataaagagctgaactacctccagtatcttttactgtaatttggccagcatctaaacttacatgcccattcgattcaaatcttgcaatattatttcctcttaaatataggtcggaaactgttggaacatagccttcaaaagttccagtaaggcccattattcgaactatcccgtgtagacgggaagaaaggacgttttttatgaaaatttatacaaattttactcatgacattcttgctttggacaatgctccagagcactacgaacacgaaatagaggtagatcgaacacgtgaggaaatgtttggggatttatgcgatgcctgtatttgtggatatcgctatgagcccaattacgaacttctcttcaatgaagatgggagtatttcccgagacgaagaaaccggcgaattacgctacaaaactgatgccaatggaaaccgtatccatacgggctggcagtgctatccatttatggattatcaggttcttatggccattcagcgccagtatgaggcatcgcaacagcagattgacgacctgacatgtgtgatggccgatgtgattggaggtgtctacaatgcttagtactatcgcaaaaaacattattatcaaggcgctgcggattcggcaggagcgtggcgaggacccagcggccgtattggaaacataccgtaatttgacgaaggccgagaaaacagaaatattgaaagctttgtgattcctatagtcaaagttatcagcatctaatatgtgcgtatttacgcgtattttcgtgcatctccttaaagctggcgtttgaacatagcctgcaatccttataaaatcgttccttttctaccgataactttgattatcggcgggaaaggagtaaaacatgggaaaagtgatgattgctttaggaggtgccgggggaattgatccggatgagtgtactgcgggaagggcgcaggtattatcaggttatactgcgggagtgcatggggaagacgatccggcgcccggaagtatgccggaaagaggcacgtggaacggatcagttggtatgaatggttcaataacggtaccggctggacatcacagtggttccggaaaaataacgggaccaactgtaacacagagaggggcatggaacagcagaatcggtattaatggtcgggctacgataccggaaggatatcataacggccagggttacgtggatcaggcgattgcgacgcagggaggtcaaacgatcaatccttctgcaagccagcagactgtatcaacatcaggaaagtatatgactgggaatataattgtaaatgcaataagtcttccaaatgcctcagatttacgtgagggcgtgaactggtatgggcgtgtcggtacactgaaagattacagttatctggcggcagggcaaacgtcttttaatggagcgtccttctccggagttctgggggagggcgctgaaatatgttatatggatccttacaataactttcatcgggatgtacccgaaataaccggtaatggattgcgtatgtatacatcaaccgcaaccaatgcatatccccatttttgtccaaaaaaatcaattaatatgaccccgtttaaacagataaaagtaactggtatgtacacaggaaattccaatggaagagggagttttcgggtagaattatggaaaaccgatgttgataaagatctactggttaggaatcaggcgatgggctggctttcatataattcagcaagtctttcttcaggaggtgttgaagtcacatgtactacagatatttcaggaatctcgggccaagcatatttaactgttatgttttctaatagcgcgtataaagaatggccaaattactttatcaaacgtattgaatttctaacgtagcaacctgccgcataatagcggcttattttatttaccacaagaaagagaggaaccattatgaacaaaaacagaccagacatgaactacaagacacccgtaccttacggaccagcaacaggaaaagaggatcccggccgccagcctgtaattgcagatactccgtatgagggagattatagcccggatcacaggcagtttaagccagggcacgttccaggaggtccggggcacaaagattgtgagcatgaataaagagaggtaagcggtgtggaaagatacgatgtaattatcatcgttgtaggactgattaccacggctctgaccataggcgcccccgtgataaaactcaacacagcgattacccggctgattgtaaagttggacagcctgggtaaggacatggacgatctggagttacataatcatgagtcgcacaaaagattgtgggatcataacgatgaacaggacgagaagctggcagatcatgagacgcgtctgtcggtgatcgagaagaaagagaggaattgactatggattttggaattgcgagtgttgcaggaattacagtaatatgctatctggccggaatggccgtcaaagctacagaggtggacaataagtggttgccggtgatctgcggcgttattggggcgattctgggggttgtgggaatgtattacatgcctggatatccggctactgacattattacagcaatagcaatcggcatcgtctccggactggctgcgacaggtgcggatcaggtatataagcagctgacaaaataagctgttgcgatatcgcaacggttgtaatatcacatttcaatagtaaacactgtattatctttattaagtcttaaaacaacgtatttacgcggtttgtcttgcctgaaaatctcgttataccttgttattctgactgatttttatatgttttcgttctcttaggtatacgggtaggtatatttaggcatataaaaaacgagaaccgcatccttcgaaaggtgcggtttttgtatgccgggtatctgtcattaggataccagaacaggtaagggaagtcaatttctttattcaatcttcccatattccttttcatgctgcatgattgcctgtcttatcagatataatatttcgccgtttatggatcgaccttcaaattctgcaagatgtttcagttttttatgggtatcactgtccactctcaaccctatatgtttatctttttccatatgacctccttaaaataagtccattttaagtatattttgtggtaaaatgtttgatatgtacttgatttaagtacacaaaaattaaagaggggtgatatcatgcaaaaagatgaaactgtgaaaagaaaaatcaaatatctggtactaagtgtcctgtattattattaccttgccggggagaaattattaatgttgaggtttaatgcagaatatattatcaagcacagaaagcttccaaagaaagtgagttcagagcaagtagagcagtttaaagaatttttaaaagaaaagagagagcatgagggatagatatcttttctcattgggttctcgctaaataaaaaccgcatccattaaaaggtgcggttttcgtatatggattatctggttgtagaatagcagatcgggccggaagaggttaattgctttcttctggctcctgatcggggacgtactccatgagatcgccgggctgacagtttaagcgagcgcatatctttgaaatggttttgctgtccagtcctccggtcccactttttagagcggtcagtgttccttgtcctataagtttttccttgcgaattttataagtagtccagccgttagtctctaataggtcaaatagtttctgataactgattgccataattatttcctgcctttcattttgagttgtatataactactccattgtatttagtatatcatcaaatgtacacaagttcaagtgtataaaaatagctaaatatatgcacttaattttgtgcatgtggtcaatagactgtgcacttaactttgtgtataataatgacataaggttgatacaataaatcaaggaggacacggcaatgacagagagcatgagagcaagagtagagaaagcagttcaggaatctaacggaagcttaaccgttgagtttgcaaatgcaactatcgcacagaaggaaagagaaatcgcatttgaaaacagccttccagcatggaaacagggctatgcaagcaagaacgcagttgctaccgctcaggcagaaatcgcttactttgaagctgttattgaatacctgacagagcaggccgcagccgaagcagtagccgagacagtacaggtgatcgccgctatcgttaccgtggcaaacaaagctaaagcagttcgcagagcagttgctacactggcaaacaagcttcacagacttaacttcagcctgtcagattcatttaagcgagcatgggcgttcgtgagagcgtttaacgggcttctgccctcgttatcgtaacattgcctaccttctggtttgtatcagccttaaaacgcaaataaggaggtctaagcaatggcaagaacagagaacaacgcacacagggaaatggaggaatatccgcctatcttacaggccagacacattcaggagcttttaaacgtctgtgaagctgtagcatatcaagtgatgcatcatgcagactgtcccacaattaagatgggaaagagaatggtagtaccgagggacgatttttgggagttcttcatggctcatagaggtaagagcttatggtaaatcactcaaaggatatcattcaggtacagggaattaactcccagggctacggaatcattcctaaaatggtgatgcaggacaaacggcttactattcaagcgaaggcgatctatggctacttctgtagctatgctggagcaggtaagacagcatttccgggaagaaagaaaataatggctgacctgagagtcagtaaggaaagttactacaagcattttaatctcttgaaagagtgcgggtatattgaagcatttcaggagaaagacgagaatggggcattttgtcggaacgtttacactctggttgaattaatcccgtgtcctaaaaatcaggactcggacgaaatttcaccgtgtcctaaattccgggataccgattttcgggataccgaaaaacaggacgctaataataacagtattaaaattaacagtatttataattatcagtctgtcagtcagaacgagacggacggacagccgtttaaagacattttagacctgatacgggagaatgtcagctatgaggacttacagacggcccacggggacgatatggagctcatagacgagtttatatccattgcccttgatgcgattgtctcaaagagtaagacggttcgaataagcggtgagtacaagccacgggagcttgtaaaggccaatctgatgaaacttacatacgcagatatagaacacgtcctgatgcagtttagggagcatgaggagcggatcaggaagaaaccgcagtatattctttccatgctgtacaactcaccgatggagttaaacgctcattatacgaactgggttagatcggacgagacaaggaggggggatttaaatggataaggaatttttggaatacttgctcaaagaaatccgcagtcataagggagtaccgtatcaaatggccaacgaggaatatgcggatgaaatgtttccatatgtgaagcagatttatccggaggctcagatggtcaagtatgacattgagcagtacatagtggtcacgaagcgggccagaaccgctcttattaagctcctgagagcttctcaagccaaacatgagaattgtatcgcagagatcgagcgggcggtaaatgagttgaatggaataatcacggagccgatcagtgacaagatcaaggagtttttcgaggaacaggagcggattcaggaggaaagccacaagcggactttagagagacataaggagatcatggcggagatcgaacaggtacgtaaactagaaggttaaaatatggaggtggatgttaatacaaaaaagactgctaaaaaaaggaatataacagtaaaatacataagattcagcagaccagaggcatatgccatagtatttcgcagtacccgaaccatttactataatgcagacttcattggcaagacacaactttatcttttcaaataaaaatgttttggcgaaaggagcacaatgaaaataaatgatgtttactatccagtcgcaggagaagcactttcaaaaaagttatgcagagacgtacctctttttgatatcccgatgatgtcagacaaaagatggaacgaacttgtagcggagcagaaggcaaagcacggtgattcatacaaggcaaaagcccttgagtaactgagtaaacagctaaacaaaggctttccagactataattagtccctcaacaagataattatagcctgggagcctccacaaagtcaacaggaggattcaaaatggctaagagaggacagggagaaggaaccatttctaagcggcctgacgggacgtggtgggcgcggatcaccgtaggccggacaccggatggcaagcagaagcgtaaggcgttctatggtaaaagcaggaaggaggtgcaggagaagcttacggcggcattgaatgatattaataaggataactatatcgatccgagcaaaatgactttggagcagtggcttacgatttggatgcgcgactacagggcacagtacgtgaagcctgaaacctatgtaaataatgagtcctgtataaggaaacatattattcctgttttgggaaaggttgctttaaaggatatacggagagatatgccgcaaaagattatcacggatatggtggcagaagggtatggtcattcgagaatcagtgatgtatatcttgtattacacatggcgttgaatgttgcagtagataatgggcttataactaagagcccggcggaaagactgaaacttcctccaaagaaaaagcaggaagcaagagtccttactgtagaagagcaggaaaaagtgatagagaagttaagagaaagtaccagtggagattatcttgaactaattctgtatactgggctgaggattggcgaagtactggctctaacttgggatgatatagactttgaggagaaaatgctaagcgtaaataaatcattatcaaagtggattatcttgccagatgggagtcggaagttacagaaaggatttgggactcctaaatccaagtcaggatttaggaaaattcctcttattcctgaagcaatagcactcttgaaaaatgcacaggaaaaacagaagcaaaaacttatggtttcaggatccgaaaatattagcaatttggtattctgcagtgtgagtggaaaatttatagacaggggtgatgcctacggagtactgaagcgcgcatgtaaaaaagctgaaatatcaggggttcatccccatacattaaggcacacatttgcaaccagaggtttggaacgggggatcccactgaaaattatgcaagagatactgggacattctaccataagcatgacagcagacatttatactcatgtgctgccagataccaagataaattccatgatgaaattgtctgtagcaaatgataaaaatagctaaaattctttgctgattttactatccaaaactagatatatcattcatagaactgcaaccttttgagggctgcggttcttgtttttttatcgggtaggtataaggtaggtatatttatatggaagagataggccatatataggcgagaaaccttgtaaatacgttgtttttagcataccttattaaattacccattgtaatatcacaactttttagggcctgggagagatcctgggccttttttgattggaggtcaaatatgagtaaaacattggacaagcttcttgctctggcagagagccagaccggttataccgagaagaataacgataaggatttagatgccgccgtcggccctacggccggtaatggcaaccatacgaagtacgcacgggacttaactgctatgggccttcctggctattgtggggccgcctggtgtgcggtctatcagatgtggctggaggttaagacgatggggaaggagcaggcgcttaaaacgctcggtccgcagttctataactgcttcgcagtccgggatcatgccaaagccacaggcagatggctggcggccggagcaactcctaagcccggataccgcgtaattttccgccagagccatatcgcattggtcaccagagtggccggcggaagaatctataccaacgagggaaataccagcaacgggaccgcagtggtgcgaaacggtggcatggtgtgcaataagtcttatccgctgaaggatagtagtattctggggtatgttatagtggattatccggaggagccagtggagcagccgaagaggtcaggctggagtcaggaggacagcggctggaggtactacttgggagacaccggacagcccgtgcgtaatgcatggtacaaggacggccaggactggtactggtttgacggcgccggcatgatggtccgtaacacgtggtaccggtataaggacgcctggtactatctggaggacgatggagccatgtgcacgggccaggtgacagtggacggcaagtggtatatcatggataatgccggccgcatgattgtggatccggtaacgctgactccagatcaggatggggcattgcagtggccggggctggtggtataataaaaaggtaaaatcgaaaatagccctttacaaatagaacatacgttcgtataatataagcaattagagattctataattgcaatatattattgaatttaattaaaagtattgtaagtacaaaattactattctataatgcaagtatactaatgcttatggtgggggtgtgattttggactttaatgaatatggtttaattaatcccgggattcatgaaatggatatggacgattttcatatcagttttgtcaagcagtttacaacgtctcagcggaggcaactaatttttgattcgttgttaagatttgtagcaaaaatgtttaaagattttaatatctacgaaatctggatagacgggagttatgtaactgaaaagataaatcctaatgatgtagatattgttatatttttttcagtcgaagattttatacgtgtttcaaaaatatgggatgttatacgaaaagatgctgtcaatattgatccatattgtgctgtagcagtaactgaagaaaataagcaaaaattatcaagcgcagatattaatacgataataaataagagaaattattggaaggggcaatttggctttgatcgtgaagaccgccccaaaggtataatcaatataaaagcagataatattgtagaatacataaaaggtggtgagtcaggtgtcgtatgaaacaataacttctctaaaacgaaaaataaaagatactgaagtagagattgacttattaaaagaagagtcgaataaagggtcaattatagccgaatttaacaagttggaactagaaagacggttagaaaaattaagagaaaatctaaagtacgtttatgaatcacaagcaaaagaaactgtttctatacgtatgtatggggatagcgttgaatatggtaagatatctaatagagtacttgtatctgtactgggagggtttcagtcggtacttgacagtatagcatcagtggcagaaggtgcttataatgctaaaggaaagataaaaaaagacgcaaaacatttaagcgattttaaagtgtgcggtacttttgcgggatcatttggaattgtcatggaaaaagacagtggtcagcatgaagtgtctcaaggatctttaaagacaaatcaagttgttagaggactatttgatgtacttgaaaatagtactgattcggaattgcttataagacatatttcaccatatggaaaaagaactataaaaaattatagagaatggctgaaggaattaaaagacaatgctgttaatttagaaatgaattggagtgatgaatcggcagaaattagacgttatgatattatgtataataaatcagatgatattatttatacgctagattccttagaagaggtctttaatgaagaaaagacgattgttggtatacttaccggtattaatataagaagaaacactttcgaattaaatactgatggaggaatcataaaaggaacaagtactttagaaacattgattggcatatcaaataaaattggtagcgaagttaaagcaaatatgataataagtactattaaaactaacgattatataacaaaaactatgtggtatttagttaatattataagctagaaatactataaaaacgggcggctcatcaccgcccaattttctgccttgcgtcacaacgcgatccgcaaaacgttatataagtatgctcattaatccgcagggtggcagctcccccatggctccgccctgtctcctacatcagtcggtatctggtgtccgacgttcgttgcgtcaaaaaccacattgcagtaatatccatatcaaggaccagttcggctatctcacgggtcttctggtattttgcgtttttgacagcctgggcatgtcgctgatatgtttcaatcatctcaaaaaacatttcgtctgttctgttcatttttccccttctttcccttatgattatatttttcacactgtcagagtatgcagccagataccttaatacattatctgtttttacaatccgggggaccagacggtgaaatgggtgcctccatgcgctacttatcccagcgctacgccatgccatataaggagtgcaagggactcctcacggatatcggaacagaggaactcgctcatcttgagattgtagcgacgatcgttcatcagctcaccaggaacttaacgccggagcagattgtggaatctggctttggtccttattacattgatcacaccacgggtatctggccgcagtctgcgggaggaattccgtttaatgcctgtgagtttcagtcgaaaggcgatccgattaccgatctggtagaggatatggcggcggaacagaaggcccggagcacctacgacaatattctgcgcgtagtgaaggatccggaggtttgtgacccgatccgttacttaagggaaagagaagtggtgcatttccagagatttggagaggcgctgcggattacccaggataatttagacagtaagaatttttatgctttcaatcccagctttgatgtaaagaataattgctgataaaaagggaggggccggcaagagggggattcttgccggccagagtatgaaaaaaagttttgtttggtttttctctgttacatgtattactatacatgggatatgtgaagaatttttgatgaaattatgaaaaaaatgtgtacatttgaatgggacaagtatcaggttagcagttgaaacctttactcaagatattgtgtatacagtatttcagcttattgcatgttgtgacttcacgggaaatctggtatatttgtaagagtattgtaagagcaaatgagacacaaggaaagaggggacaggcatgattttagtagcaaaacgtgatggggcaatcgtggaatttcatctggaaaagatctccgaagctataaggaaggcgtttaaggcaacggggaaattttatacggaagatattgtggaactgctgtcgatcagagtgacgtctgattttcaggggaagatgaagggcgaccagattgcggtcgaggatatccaggacagcgtggagaaggtgctggaggaagccggctatacggacgtggcaaaggcatacatattatacaggaagcagcgggagaagatcaggaatctcggtaagacaacgctggattataaagatgtggtggacaactatgtgaaggtggaagactggcgggtgaaggagaactctacggtcacatactccgtgggcggtctgattttaaataactcaggcgcggttacgaccaattactggctgacggaaatctatgataaggaaatcgccgaggcttatataggcggtgatcttcatattcatgacctgtccatgctgaccggttatagctgtggatggtctttaaagaggcttctgatggacgggctcggcggaattactggaaagattacagcatctccggcgaagcatctggccacgctctgcaatcagatggtcaatttcctgggaattatgcagaatgaatgggcggcatcccagtcattttcctcttttgatacgtatctggcgccctttgtcaaggcggacaacctctcgtatgaccgggtgaaaaagtgtatggaggcctttgtctttggcgtaaatacgccgagcagatgggggactcaggcaccattttcccatatttccctggatttaatggttccggaggatatggcatcgcagaaggccatcgtgggtggacaggagatggatttcacctatggggagtgccaggcggaactggatatggtggaccgggcatttctggagactatgctggagggcgatgccagcggactcggttttcagtatccgatcccgtcctatggactgactccggacttcgactggtctgataatgagagaaaccggcttttgttttcgctggcttcccattacggtacgccgtattttacgaattacgtccgcagcggactgacaccgggagatgtgagaatttcctatgacggggtaactcctgatttacatgagctgcgcagcaaagcaggcggtttcttcggatatggggaacatacgggatcgatcggcgtggttacgattaatttgccgaggattgcatatcagtcgaagaacgaggcggagttctatgagaaactggatgagaagatggatctggcggcgcgttccctgcggacgaagcgtgaggtaatctccaatctgctgaagaacggcctgtacccatatacggcctgctatctgtctgatttcagcaaccatctttcgtccatcggcattatcgggatgaatgaggccggcctgaatgcaccgtggctgggagagggcatggaatcggagaagacgagacagtttgccgctgtcatgttaaatcatatgaaggaaaagatcgtgggataccagctggaatacggggatctctacggtcttgaggcgacgccggctgagtcggctacctaccgtttcgccatgctggataaggaaaaatttcctggtatcaggacggcggggcacgaaggagatgcaccgtattatacgaacagtacgaagctgcctgcggactacgatggttccctggaagatgctctggcgaatcaggatcagctgcagccgctttatacggcaggaaccgtgttccatgtttatatggaacgcgagtttgacgactggaagaaggcgcgggatcttctgcacgacataacgaccggtcatgatattccttattatacgctgtcgccgatctactctatctgccagtcctgcggatatctgccgggaaggcagaacgtgtgtcccaaatgcggaggccgcgccgcggtctacagcagaattgccggttattacagaccggttcacgactggaacgaggggaaggcacaggagttcaaaaacagaatcatgttccgtgtctgagttttggctatcctgtaagcagcagtgaattttccgattatgcacatctaaggtatattcgcatatgatatagtacaaacctgataaattaaaggagatcaatcatatgtgttgttgtaataatagatgtaatgtaaattgtggatgtaattgtggatgcggttcctggagctgtggatgcggaaataacaataataacaataataattcctgctcatgcagaccgaatgactgggctaactgccagttccgccgcggctatgctgcaggctttaacgcaggttatgagaccggcttcagagatggcttctgggcaggcaataataacaacgtaatgccaattacggctcctggcaccgctgctgaaggcggatgcggatgtggctgccgctaatcacctcgtaaaaatggatattcgctgacacgataagatccgccggcacgttgagtgccggtggaaacagtaaaaagaaaaaagaaaagccaaaagccaaaagccaaaaacagaaaagcttttatgaaacgcagaaatgagccgtttcatagaagcttttttcctgcgtttccccagcgcatatctgaaaatccattccacccgctgcccactccgcttcgcagcatattaagcccctatacagtcagcgcagcccgctgcacctcctccattgggactcaatttcccacaacgtctgacttacagctgacgaaaagcaattttcagacacacgcaggttttcaagagccgatcatccggataagaaaaaataatgacaaaaaaagggaatatagtttggtgatattgcacattgtaaaactgaatacattatgctagtctatatacaagtcattgaggttgtatacaaatttaaagatttgaatacatttttaaaaacagaccgggatgacggaataactgaccagaccaaaaaagaaataagtaaaggagaaacaaatcatgaacatggattacttaacagacaagttttcgctggacggaaaagttgcactgattacaggtgcttcctacggaattggttttgcaatggcaaagggaatggctgcagccggcgcaacgatcgtgtttaacgatatcaagcaggaattagtagataagggaattgcttcctataaagaagagggaatcgatgctcacggctacgtatgtgacgtaaccaatgaggctgctgtgaatgagatggtagcccgtatcgagagcgaagtcggcgtgattgatattcttgtgaacaatgccggtattatcaagcgtatcccgatgtgcgatatgaccgctgagcagttcagacaggtgattgacgttgatttaaatgctccatttatcgtttccaaggcagttattccgtctatgatcaagaagggacacggcaagatcatcaacatctgctccatgatgtctgagcttggacgtgagactgtatccgcttatgcggcggcaaagggcggcttaaagatgctgaccaggaatattgcgtctgaatacggtgaattcaacattcagtgtaacggcattggacctggctacatagcgactcctcagactgctccgttacgtgaggcacagccggatggctccagacacccatttgaccagtttatcatttccaagacaccggcaggacgctggggagaagcggaagaccttgctgcaccggcagtattcttagcttccgatgcatctgattttatcaacggacacgttctctacgtagacggcggtatcctggcttatatcggcaagcagccgcagtaaatgactggaaacagggaccggcgggaacggtaacgctgcatagccggcaattgaccgcaaagagaggttatgctatactatgagcacccggtgtacttaagcctggttataaaagaacgaatattcatgccatgattctgttttcggcagagctcatggcatgttttttagaaatgatgacggagaggtgccatggaagagaagacgaaagcctataaaaaccgcggggagctcgtttttgagacgttaaagcgggagatactggacctggagctgaaaccggggcagatgatcagtgagaatgagatctgcgagcgtttcggcgtttcgaggacgcctgtgagagaagcggtcagaagactgcaggagcaggggttcgtcatttccgtgccctattccggcactcaggtaacgcttttaaatttgagcaatatcaaacagatgatctatatgcgcgtggcggtggagaccatggtcatgcgggattttgtggacattgcgactccgctgtggatggaggaggtccgctacatgatcagaaagcagcaggccctcattcaggagaagggattcgagccggaacagttctaccgcatggatgcagagatgcacgccatctggttccgggccacggacaagatgaagctctgggatatgattcaggcgcagcagcttcactatacccggttccgtatgctggatttcgttacagagacggattttaccaggatcatacgggagcatacggagctctttgaactgctggagaaaaaggatattgccgggctggagcgttccctgaaggaacatctctattacagcatgaaacgcatgaaacaccagatcgatgtggaatataaagattattttgaacaggaggaatagacgatggcgaaagtatcgattaccataaaagatgaaaatggcgcggtaaaaagctctgtctgcggtgaggaacgggccgttctcgtttacgagggcgcgtactgcgaaggagataccatcacatttacgacagacgcagtgaaccagcactacgtggttcgtgtggatgacaccatggacgaggcgcttgtttatatcacgaagcccgaagtggtttatgggatcccatttgatgagaagaaggtttcctataatccaaaatcatttgccggggagaaacactatctgaccatgagaacagcggaggcgtatgagaccgcggcttaccgtaatcttgcgaagaacgtgatggaccagcacggcgatccgggatgttatccccatgtgtatgcgaatgtggagacacgcggcgaagcggtgttcgcagcgcgcaatgccattgacggcgtggtttccaacgaatctcacggtgaatggccgtatgagtcctggggaattaaccgtcaggatgatgcggagatgaccctggaattcggccgtcccgtggattttgacaggattgttctcgttacgagagccgatttccctcatgataactggtgggtaaaggcgacatttaccttttctgacggcaccacggaagtggtggatatggaaaagagcgtgaagcctcatgagttcagaattgagaaaaagggaatcacctggttgaagctcagcaatttgatcaaggcagatgatccgtctccgttcccggcgctgacgcagattgaagtttacgggaagtaagagactgcaggaagcaggagaaaatgaagtgcaaatataaggtacgcagccccgccggggtctgcgtaccttatttgtcaatttcttcacgatatttgaaatttcctctttccctttttcctttattcgagtaaaatggtactatgacagacaccattgaggggtggtataatgagtcataataaggaggaaaacatatggaactgctgtttatggagcctgtgttcaaggaagcaatatggggaggcacgaagcttcgcgacgtgttcggctatgagattccaagtgataccacaggcgaatgctgggctgtgagcgcccataagaatggagactgccggatcgccggcggtatgtatgacggacggctgctgagcagcctgtgggaagagaagccggagcttttcgggaattatccgggagatcagttccctcttctcgtcaagattattgatgcaaaggcggatttaagcattcaggttcatccggatgacgagtatgcgaaggttcatgaggacggatcgctgggaaagacagagtgctggtatattctggactgtgacccggggacggagattgtcatcggccaccatgcagggagccatgaggagatggaagccatgatccgcggccatcagtgggacgaatttatccgcaaggtcccggtgaagaagggcgacttcttccagatcaatccgggatgcgtccatgccatcaagggcgggactctgattctggagacccagcagagcagtgatattacataccgtgtctacgactatgacagactgtccgatggaaaaccgaggcagctgcacgtggagcagagcattgcgaccatcgaggcgccgtttaaagaggcctcctgtgacacctttacggaaaagataccgggggctgtgcacacgcacctcattacgtgtccgttctattctgtggacaagtatgagatcgacggcgtgtttaccagggaattcagccggttttttgccaatgtcagcgtgatcagcggcaaaggctatgtaaacggaattccgctggaaacgggacagcattttatcgttccggcaggagcgggagaattgagatttgaaggaaagatgtcggtgatctgttccaatccggagtcagggactctgtaggaagctgcggcacatcgggattcagataaaggaagaatacagacaggaggagtaatgagatgagacttggagcattagaggcaggcggaacaaagatggtttgcgccatcggcaacgaacagggtgagatatttgagcgggtttcgattccgacggagacaccggagattacgatgccgaagctgattgcatattttaaggacaaggagatcgaagcgctgggaatcggctgtttcggtcccatcgatttaaacagaaagtcagagacctacggatacattaccacgacaccgaagctgaaatgggccaattataatatagtaggcgcgttccaagaggcgctgggtgttccggttggcttcgacacggatgtgaacggctctgcgctgggtgaggcgacctggggcatcacaaaggggctggaaaacagtgtgtactttaccatcggaaccggagtgggcgccggaatcatttccaacggaaagctgctccacggcatgcttcatccggaaggcggccatgtgcttttagcgaagcatccggacgacacgtatgcgggaaaatgcccgtatcacagaaactgtctggaaggtctggctgcgggtcccgccattgaagagcgctggggcaagaaaggaatcgagcttgcagacaggaaggaagtatgggagatggaggccttctacatcggccaggccatcgtggattacatcgtgatcctgtctcctcagagaatcattctgggcggaggtgttatgcatcaggagcacatgatgccgttggtgagagaagaagtgaagcgccagctaaacggctatatccagacaaaggagctggaggatttggacagctacatcgttcttccaagcctgaatgacaatcagggaatcatgggagccttaaagctcgccatggatgaactggagctggcagagtaagcgggaaattgccatttttctcctagtgataaagcggtaccagtatgttatgatacattttgtaacagaaatgtaacaattttgtaatatacaaggaggactttatcatgagaaagttaccattatttgttctggcagcagcaaccgcactgagcatcgccagtgtaccgatgacggctcacgcagcgaccatccaggtagttggaggcggcaatggtatgaatggttatatgactaactgcagcggacagaccggcaatttggcaaatatgttaaatcagctgggcgcgggtacgggcagcagaggcagcttgggctgcggtctcggtcagaacttagcgggtaacggatcctgcggttacggccagggctgtgcggacaacggatcctgcggctacggtcagggttgtgcagataacggatcctgcggcttcggtcagagctgctccggcaaccagaactgcaccaacggtcagagctgcggcggaaatcagaacagcggcatgaacggacagaattttcctttcatgatgatgcgttagagcacttttcaaacacgctctgattcacggtgcggctacggaagaaaaacagcgttagaacgaatagaataaaaagaaaaatgatacataaacagaaataaaaagcagataaaaaagcagagaaaagaatctccgcctcgcagatcggaatgcgcggcggggattctttttttctcctgcgattttcttctgaaacaggaatacgacacatcccccaatctgcctattgacttttaatttccacaccgctataatccattacgtttaaaaagataaacacacttctaaacacacttcagggcaaaacaaggaggcttggaaagatgaagcagatatgggccatatttctcagagatataaagaacataggaaaaaatccggtggcggttatcgtagcgctgggaatcatgatactgccgtcgctgtatgcgtggttcaacatcgcggcgaactgggatccttacggcaatacgaaggggctccgggtggctgtggccagtctggatcaggggacacggatcgaacagctggacaccaccgtaaacatcggtgacatgattatttccaatctccatgaaaatgatcagattggatggcagtttgtggatgaggaacaggcggtggagggcgtgaaggcgggccgttattacgcctgtgtcatcattccggaggacttcagcgagaagacggccagcatctttacgtcgaacgttcagaagccgacgcttcagtactatgtgaatgaaaagaaaaatgcaatcgccacgaaaataacggataagggcgtcagcaccatccagcagcaggtgaatgaatccctgatcagcgcttcctctgaagctctgggaaaggcatttcacgtcacctacggtacggtggaagggaagaaggaggatctggcggatgagatggtgtcctccatgaaggatgccagaaatgacctggttctgatgggcagctcggtcggcgcattaaaatcgtctctgaccgcgggaaaaggtcttttaagcagtgttcaggcaatgcttccggattccaaagagctgcttaagtcggggcaggacacgggagcggaggccagccgtctcatccgcacctcagaggatttgtccgacaccatgacagacagcgtgggaaatgtgctggacatcgaagatggcctgatggactctgtggaccgctcggtccgcgatgccattgaccgctgggaccgcgatgcgaatgcggcagcaggggaattaaacaaggcctctgacgtattaaatacactgctgaatgtgaaccagaagctttatgatctggtgaacaatttaaaggagaagattcccggaccgggaaaggttctgggagtgctggccgatatgattaccagccagatcgacaggcagaaaaatatgatacatatgatagagacggcggaggacacggtcttaaggacggggaagcttccggaggacgccagacaggagatcaggaaatcactggaggagatgatggatcagggggcgcggattacggatcagtatcacagccaggtgaaaccggccctgacggcaggactggacagtctttatgacagcatttccgccgcgtcagattacgcagtcggcattaacgggcttctgccgcagattgacggcaccctgactcagaccacgggttcctttgacagtctgatcgagacgctggaccagactgcgtccatgattgcggccggtgaggaaaaactggaccgcatcatcgatgaggtggaattcgtggaggagagcgagaggctggccaagattgtggagatcatgaaaaatgatccggagaccatgggggatttcctgtcatccccggtgaatctggaggagaatcagatctatcccattgaaaattacggttcggccatgactccgttttacacgattctcgccatatgggtgggcggtctggtcctggtggctgttttgaagtgccgcgttgtggaggacgagaaaattcatggcggtaaggcgtatgaaaaatactttggaaggtacttcatctttatgttgttcggtgtggcgcaggcgcttattgtgtcgctgggagacctctacctgctgaagatccagtgcctggagccggcgaaattcgtgctggcggcggtgctggcgagcgtggtgtttgtcaatatcatctacacgctcaccatctccttcggcgatgtggggaaggccctggcggtcgtcctgctcgttattcaggtggccggggcagggggaaccttcccgatcgaggtgacgccgcatttcttccgtatggtcaatccgatgctgccgtttacacacgccattaatgccatgagggagtgcgtcggcggtatctacggaaatgcctaccgcgaggatatggcaaaggtcctcttatatctgcccatctccctgtttgtgggcgtggttctgcgaaaacaggtgatcaggttgaacgatttcttcgagcgcaagctggaggaaaccggggtgatgtaggtttaacagccagcttcggcggtgtggcagcgcattccggcccggtagtgaaaaatcatgattccgccaatggtgagtgctgaaaacagagggaacagaagccagacatacgacagggaaagaccgcttacgatcagacttcccagtacggaggcggccagccctccagcccgcagggaaagggagagaaccgacatcatgcttgcgcgctggtcattgccgacggcctcgtggaagactgtattttcaatcagattcccggcgcccaacacaatgtagaccaggacgaagagggccagaaacagccagacccggtgggtaaatcccagggcggcgacgcttaacacgagaaggaaacgcaggatccagtatgtacgccagctcttttctggtgtgagcattgcttttttggactgcatggctgcctcggccgctttactgccgatggtgacacctaagtagcccaggcaggtgaccacaccgaagatccatcccagctgctcggggagaaatgtcttgagcgtcggctgccagtagacttcgacggtacagagaagcagcccgtaggcggcagacatcagaacaatggtgatgaccgaaaggctgtttcggagggagtgatacaggccccggagctgctccttaaactggagggcgggggaaagggggctcctttcgcgggcaggctccttcacaaagcaggcggccagaaacaggataagcgcctgtatggccagagccaggatcaggagaagactataggagccgtccagaaatcccaggacaccgccggtaatggacccgagagccagaccgacgctgtcgatgacagccatggtgctgttgatcttttccagattccggccctcctgctcccggagatacgtctcgatctccagagcctcgatggagccggagctgaaagcacggccgataccctgcatggcacacgcggcggccagcatgaggaaatggctgctgaacataaggaggacgtagtttgccatcatgaaacaggcagacagtaagaagattcgtttccttccgatcaaatccgccataattccgctggggagttccagcacgacgaccatgacggcaaaaattccgatgcacagcgacaggttttccagggtggcgccgtggcttaagagcacgagggagagtaccggcgcgagaagtccggtaccgaaggcattggccccaaataacaggatgtggcttcgtttcatgatggctgctcctccttttcttccgaaagcggactgtggggatatgccaccagaccaaattcccagggaatcgtgtcttcgcccggaaccgagtgtgcatcggtgaaatccaggattaagtggtacagctcctccgcatcttttttcgataaatggacgactccgctggtaaaatctccggtcgtcatcacatcagacttatctttcgcccgctttaggcggtctttaaaaccattccagagttccgtcatgatataatccgacagatagaagcgctcttcccttaaatcatcatccagattcccgcctatggagacggagaccggaagctttttatagaatttcgcctggatgccatggatggattccgtgtggtccagctccagcaggcccagctcctccaacttcctgatatggagcgagacggaagaggccgatatctttaagacattcgacagctgcttgggggtcatgggcttaccgcttacttccagggcctttagaaggcgctgacgctgcgggttcatatagatatccatttgtttccgggtagccagtgttatcattttctgttctgacataagatcctcctttacggcagaccgctttttgcagaccgggagaaacagaatcttccgatggtgcggggcggtgtcgttttccttccgtctatgtgcttttttgtaatatatgatacttttattataacgttacatattatgtaatgtcaaggcgattttataaatcttgccggccatcctgttttgtggtattcttgagatagatttggcaaaacaaaaaatccggaccggagccgataactgcttatcgggttccggtccggattctgggtgcggatcacatgattactgaccttcgttcacgatttcctgcagaacgttgataagatcgtagatcgtgttaatctgcacgttccgatccaggatttcatttttcaaatcgatggaaagcgtctcgaatttggcctggacggcgggagcaatataggacatgttcatcacctcctggttaggatgtgtagtgagaggataagatatacggattgtggaagagaatttgactgaaattgcaatgtgaaaaaataatatgcgaaagatgggggaatcagagttgagaaaaaaagagtgcaatggggacattcaggaacggaccggcagatacaatggtttaattgaaaagctgattcaatgggggaaccgcgatgtgcgggtgtatttggccctgattatcggttctcaggcgagatcagatcatccggcggatgaattttccgatctcgatgtcattattgcggtggatgactcccgctattttatggaatccaacgagtggctggaggcgatcggaacgtattatattacgttcaacgaacgaactgtgaacggcgacgatgaaaaaagggtgttgtttgaggaggcgctggatgttgactttgtaatactttcccgtgagcgcctggagtatgcggtgaagaataatgaactggatattctgaagcggggataccgcgttttaatcgataaaatcgggattggagccgaagctttgccgcttgccgatgataaaccggttcctgtaattttatcggaacgggactatacaaatattgtgaatgatttctggtatcacgccgtgtgggcgaagaaaaaactgctccgcggagaactgtggatggccaaaagctgtattgataactatatgaaaggccttctttttaagattgtcgaatgtcacgcccacgcgataaacgggccggattacgatacctggcatggcgggcgcttctttgatgaatgggccggggactggattgtagagcggctttcgtcctgctattcttattatgaaaccggtgatgcagaacgggcgctttcttcaaccatggatctgttccgggatgttgccgtggaaacggcagatcggatggaataccggtatccggcggaagcggattcgtatgcggcgggttgggtgttgcagaggaatgagcgtaaggcttctgaataaaagttactgtctgaatatacaaataaaaaataccggaaatccttttttagaggactccggcatttttcattttggtggttctgagtataccattcaggataagaggaatgctccagtaatgaaaaactagagcatggttatactggttacatacggttcaccgtttagtggctgataaatatctacgacagcaaactgtgggtttaaatcttccgtctgcggttctgcgattgtcatgaatttgtaattggttccatttactacctgcgttgctacggctatgggagtatagaagaaatcgttatgtcttccgattgcgttaaaaaatatgaaggagtcatatggcgtaagatatgactgataagaccatccgcccggcatgggtcacctcatgaacgttagttagtacagtatatgcatttctgtttgaattgtcgattcctattttacataatttgtcgctatattttcgtacaggcggcagataatatagggtgagggaacagatttggggcgtaaaaataacatttgtgcacgcttttatacattaccgcacatatttgtaaccataaaatggatatttatggtataattaaccatatcgtccacaacaggaggattccatgcacgtttttaatccggtattttatgatgaatataacctgatgaactatctggattttgccgttatgaagacggcgaagctgtatccggatgtgctgcgggaggagatttatctgctgttctatttaataaaagataatttccaggccaatatgaaatatctgagagagaacaatgtagacgtggattgcttcggcttcctgccggtcaggagaaataccaggaactccgtggaagcgttttttgacatgtttaatttgattaacgctgagaattatatatccgttctgctgtatatgaatgataaaaagaataaccgatacgacgatctttataagaaatatgcgtttaaaggtgattttacaatcatcagcaagagggatatcgcaaaagatcatggcttaggccggattactgatgatgagaagatggctaaaatcgaccaggtggagagcggatccaacagttatattcatccgagtatctttatccccctttatacgcctgcggacattgaggcaaaggaggagatcctgcgtgatttactccgggtcaatacctggctgttaggcggcgcataccatcagctgtgctgttttatattgaacaaatatggctccctgaaatcctttgaatgccttcactgcacgaagaatgcggcgtgttttgaatgctttgaaaattattatgtttcatttaaagagatgattgaacaggagctgtttccgctgagtcaggaatgcggcagtgatgaaccatttaaaaatatgaggtaaaagctatatgaaatacaatttacgctcactttatttgtgtgcggatgagatggaacgggctttttgaagttttacgaggattgcggctgggattatttgcgtataaaatgatgggggaggaacatacatatggaagtaactgcctgccgggtctcgacgtggaaagtctggagctgctgaatcagaagctggagagcctggagctttgctttcctctgacgaaaattaaggacaattgggctgcggaattggtggacagcgaagggaatcatatcgaaatgaccgcgccggtttaacgaaatgataaggattggaatgatacagcatcattcccgaaaggaacgacatggagttaaaatatattgatataggattaaatttgatgggaaagcagttcgattcagaccgggaaacggttgcagccgattcgtttgcagccggtgtcggctttatcgtgacgggaacggatctaaaatcagaccgcgcggcggtcgattatctgaaaaaaagcagatttgagcatgcatggtgcacctgcggaatttcaaggggctgccgcggcgaaatgttccggtaaatataaagtatgtggcagaaaagatcgccgcagtcaaaaatacagacgttgaagccgtggagcaggcagcgcttagaaataccaggcagtttttcaatctataaactggttaatggattgtcatatgcagtgaaataaaatgtgggaggaaaccaatgtcaactacatattatatagcaaacagaaagagaaaaaaagagtgcgaggagtttaagaaattttgggaagaagaatggtttccggagattacagataagctttaccaattctgtactgggacaaacggtgagatcgtaaataaagatctggcagagagcatcacagaagataaaatgtgcgggttttcctgcacgccgttgagcgataccttatacgaggaggcgtttcttacggtgaataagtccggcgtattctggcataagtgtgaggtggaaggcgttctgctgaacagcctcgaggagctgattaaatttttttcgaagaaggccaaccaggagacgtattcgctggaggatcaaaacggctgggtatgcaccctgaatgatttgatcagggagcttagcgggaaataaaacgtgtgcagggtgctggtggaacgatggagatgcttctgactgacaaagggttaaatgtgctgcagacttttgaaaccggtatttcttctaacagggaaatttttatgagggatgatgatatctactctgtggtcgtgacctacaaggactttgtcggaagtaatgatgtgaaaatagagaagtgatcagatctgtatttccccattagaaaatgccgggagcctttatgagaaaggccttccggcattttgcgaagaattggagtaacaggatttaaaatgttgtgcattaattatgatggggacaggtgacgattacttattaatttaactgcagactgtagatgtataattaggaaagtgtcaggtcgaagagtctgtaatataataaagtgtaaatttataatgtgattatatgggaggggttatggcaattaattgttgtatttgtaaaaagaaacatagcggttggataatagattatgcattatctcccagtttaaatgaacacagagtgtgctcaaaatgctgggaatagcttcaaagaattaaaaatgcaaaattattcgaagatgtaccagatgatgtaaattatattagttatgctattgaaaacaatgaactagatcaaaaagtaaaagactttttattattatacttagatggtaactttaatgaattaacggctaaggaaatagatgacatattgattcaggagcatataaacgagcttcaacaaattatggttacatcaggttttaattttgacgggtataaaatagaagaatatttaggttatatttctggagaaacagttataggcatgggattattgaaagcattagcggctgatttttcaaatttaacagggaccgaatcagcggaattaactaagaaaacgggagagataagagagaaatccatgatggcattgcaaatggtacagctgtaaaaatcaagaatattagaaatttttttgaggagaatcaatatgaaaaacgataacagaaagagaaatggccttttaactgcttccgcgatcttctacatcctttttgctctggatttgattgtgaacaccgctcttgcccatatccttaacggaggccaatcattgattgcaaatgcaatgatgttggggccctttgttgtaaatgtaatatccctgtcaatatcgttttccattgctacgatctttttggttatcgggtatatatgcgcaaaggtgaacaaagaaaagtaaaattggatcataattaaatgattgcctctggacaaaatgtccagaagttcacgagattcctgcagatccaacggcgaatgaaacagcaaattgttttccgtacagaatgaaagccctgtcaacgctcggtacttattctaatatataatgtccgtaggcaatgtctcttggccctttgattagcgagattctgcacaaagcgagaaccagcaaaaatggctgaaggttttataaagacaatggatacgagatgtatttacttcattggtaattatgactcttgatgagataataggaagatgtttgaatatatacaactttattcattagtataccggtgtttgtgcctggagttaaaacgttaatatagccggaaggttgaaatgttgcaaataaaaaggaaggattaatgataatgtttgatctgaataaaaagtattttaaagatatgcagcatattgtctacaagcaatgggataacattgaaattaatgcagtattaaatggaattaatccaggttgggtatttgtgaatgagcaaatcaatccgaaaacagcacttctctggtcgcgcgggatagaaggattctactttattggcgaaccggacaatgatcagtttaatcaaaatgcatgtgattttgttatgaatattcttgataaacggataaggcaatcgggacttaattattttgaagttagcggtgatcgaccagagtgggattctatattagaacagatctttgataaacaagaattaataaaatcaaggcagtgtgtctataaatttgacttggaacgttggaaagatcatgaaatgagatcagatcaaaaaggtgttactgtctataggattgataagtcattttttcaaaatagaatagaaaatttttcttttgttgaagatgaaattttacgatggtggaattcgcttgagcatttttttgagcatgcttttgggtattgtgttgtttgtgatgagataattgtaagctattgcctgacaaattttgtttatggtaatacatatacattaggcattgagacgctaaaagactatagacgaaagggttactgccaaattgccgttgaagcttttattacagacttactagaacatgatagtgttccatactgggattgtatgtatacaaaagtggcttcaagaaaacttgctgaaaaaattggcttttatttagaccatacatatgctttatatcgaattttactgagcgaagaggagtgaagtccctattcaaattttcagtggtaccatgttctctaaagtgcagttttttattttttctaaccgatttcttattagagatatgtaataactcctattgtaaaataaaaaagggatagccttggaatggtcagagctcaatttcatcaacgaaactgttttatacaacgaatgaaaggatcgtactggtataaggcgaactgccgcttcaaaaatggaaaatgaggcgtctttttacaacaaaaaagtgccgaaagccttgtaaatacaagggattcagcacttctgtgtgaatcggagtaacaggatttgaacctgcgacctctcggcccccagccgagcgcgctaccaagctacgccatactccgtttctggtcactatggtattatagcagaaagtttgcgatttgaaaagtatatttgttgaaatattttatattttaagatatgatggtaaggacgatatgattcatggagaaaagacaggtgagaaagaatatgaaaccgatcgtgagttttgatgtagatatgacacttttggaccataaggactggacgataccggacagcgccatggagaccctggaacggctccgggagaattacaccattgttctggcaaccggccgcgacatggattccagcttcagcgtcgtgttaaaggaacagatcaggccggatgccatcattcatttgaatggaacgaagattacggtgggggacacgattatttacgagcatctgtttgataaggaactgatgagacagatcattgcctatgcacaggatgatgcagcctgcagcgtgggagccagtgtgggcgggtatgattactacgtgcatccggaagtggtgaaccgccacgatacggatctttggggagaatgcggacgccggtttgcggatccgtggaagcttcctgatttggacgtcaggacaatggcatacattggagatgaaaagggcgcaaaggccatgggggcccggttccccgaggtaaatgtgcacatgttcgcggaaaaacggggcgcggatgtggtggagaagacagccagcaaggctatggggctgatccgcctctgcgactattttaatatccctctttccagtacggtggcgtttggggacagcatgaacgattacgatatcgtgaagacggcaggcatcggaatcgccatgggaaacgccatggaagagcttaaggaagccgcggattatgtgactgatgccgtggattcggatggaatccgcaatgcctgtgtgcattttgggctgatccggttataagggtgtgtggcattacttttatgaaaatatacagggaaggaaataagtagcatggcaaaacattatgatatctttatcataggcggcgggcccggcggttatacggctgcgcttaaggcagcagggctggggcttaagactgcaattgcagagaaggaaaaactgggcgggacctgtgtcaataaggggtgtattccgacgaaggctctgcttcatgcctccagtatgtttgcagcgtttcagagctgtgatgtatttggagtatcggctgatttcatttcttttgactttaagaaaatgcaggactataagaaacgttctgtaaaagagtaccggaaggaagttcgggaatcgattgaaaatgcgggggtcgactatatcgagggaacggcgacgatccgccggggacggaccgtggaggtcaacagtccttcaggtaaagactattacgaggcagatcacattattatcgcaacgggggcgaaaccggtgataccggatattccgggagcgatgctgccgggcgttctgacgagtgaccggctgctggcttctgatacctggaattacgatcgtctcacgattattggcggcggcgtgatcggagtggaattcgcaacgatattccaggcgctgtgctcccatgtgacgattatcgaaagccgggagcatttactgggacctatggacaatgaagtttccgaggtcctggaaaatgaactgagacggaaaggaatcgctgtccagtgtgaggcaaaggtcctggaaatccgcgaggaggaacagggactcatctgcgtttatgaggcggatggagaggtgcggacgatccgttccggccagattctcctggcagcaggccgaaagccgaatctggatggactttttggacgggatgtcagccttgccatggaagacggatgtcttaagacggattcggagttccggaccagtgaacccggcatttatgccatcggcgatgtgacggccggcaagatgctggctcatgtggcggcggccgagggtacttatgtggttgaaaagatcgcgggcgtgcatcacactatccggctttctgtggttccgaatggcatgtttgtggaacttccggtcgtgccgggatgcatttataccgagccggagattgcttccgtcggaattacggtggaagaagcgaaggcccataacatgaaggtgcgctgtgggcgctactccatgagcggtaatggaaaatccatcattaccagagaacagagcggatttattcatctgatttttgaggaatattccggaaccattgtcggcgctcagatcgtctgtccgcgggccactgatatgatcagtgagatggcgactgctatcgcaaatggcctgacagcggatcagctcatgcttgccatgagggcccatccgacttacagcgagggcataacggcggcaatcgagaattattatgaagcaaaaggagacgaaaggttatgattcaagagagaattgcagcattacgaagcctgatggcggagcgccagattgacgcttacatgattccaacctccgattttcatgagtcggaatatgtgggcgattattttaaatgcaggaaatttataactggttttacagggtccgccggtacggcgattatcacgcagacagaggcgagactctggaccgacggccggtatttcgtacaggcggcgaagcagctggagggaaccggcgtgctcctcatgaaatccggtcaggagggcgttccgaccgaggaagagtatctggcagaggttatgcctcagaacggaaccctgggtttcgacggccgtgtcgtcaacagccagctgggagagaagctggaagaacttctggaagacaagcacgtgaaattttcctggaaggaagacctggtggatctcatctgggaagaccgtccggcgttatccgctgaaccggtctggattttaaaagaaaactacgcgggcaaatcagcagcggataagattgccgatttaagggaagcgatgaagaaggagaagaccacggtccacgtcctcaccacgcttgatgatatcgtgtggctgttaaatatccgtggaaatgacgtcgtctgcaatccagtagttctttcctatgcattggtgacgatggaacggttctatttatttatcaatgaggcggttctggacagcgaagtgaaatcctatttaaaagagctgggcgttaccgtacggccttacaatgatatttacgatgcggtgagccagttaaagggccagaaggtgcttctggagacagcgaagaccaactatgcgatcatcagcaatctggatgaatccaatgcagttgttgaccgtatgaatccgaccgctccggccaaagcagtcaaaaatccggttgagatcgaaaatatgaagaaggcccatatcaaagacggtgtggccatggtgaagtttatctgctggctgaaaaagaatattggaaagcagacgatcaccgagcttgacgcggagcattacctggataatctgcgcgcagagcaggagggaaatctgggactttcgttccataccatatctgcttatggggcaaatgcggcgatgtgccactattccgcgacgccggagagcaatacgactctggagccaaaaggactctatctggtagattccggcggacagtattatgagggaacaaccgatgtgacgagaacgatctccctgggggagacgacggaagcagaacgggaacattttaccctgagcgtcatcagtatgctgcgcctggccgctgtaaaattcttatatgggtgcagaggacttaccctggattatgtggcgagagagccgctctggagcagaggactgaactttgaccacggaaccggccacggagtaggttacctgttaaatgttcacgaacgccccaacggtattcgctggcgtatggtgccggagcgccaggacaactgtgtactggaagaaggcatggtgacttccgacgagccgggcgtatatattgaaggcagccacggtgtacgtacggaaaatcttattgtctgcaagaaggcagagaagaacgaatacggccagtttatggaatttgagtttctgacctttgtgccgattgatttggaagcactcgataaatccctgatgaacgagcgggatgtggaactcttaaacagctaccacagtgcagtatatgagaagatatccccgtatttgacagcggaagaggctgaatggctgaaggaaaatacgagggcagtataagcaggcgtaaataaaaaagcatataaacgatataaggcggagccatgcggtgtggatcctgtcaggggcggtgaaaaatagattttcatcgtcttcctgacgggaattcacgatcgctatggttccgcctgtttttgggttatttctttacgaagccgcatcagaagcggaataatcgcttcccaatcctcttgatccagttctttcagcaactccacggccctgcggaactgtggcggttccgccatttctgtatcaaagaattccagcggcgtaatttccaggtaatcgcatatttcgaagaattgtttcatggaaggcatggagcggccagaggaaataccctgaatgtaactcttatttttaccaagatccagactcatctggtattccgagacatcctttttcaaacggagctctgtaattctgtttctgacaaactgttcattcattcttatcacctctatggttaatcataaaggataatctttcccgacattccgttttatatgcgtaataatggcagaaaaatcggttgcatatacggataaaaagcgttattatataagttagaaaaacgaaagagaatgttaaaagaaagtgcgtgcctatagggcgagaggatgtccgatgacagaatatttaaaaaagtggaaggataaatggtcctggaaaaacggggcttttttatgcggcctgatctatatcctgattatggcaggaatgtttggctgctgccgaatgcagtacggaggggcggcaggcggcttgattgcggctgtgtttgtcgtatctttggcggcaatggccgtgatgactgtgatttcttatccggtgaggagggaaaaggagataatgcaggagtgtggccaggggcaggacgggcaggaggtgcaggaagcattgtaccggagactgggggaatttgccgatacggtcctgtttgagtatcgataccgggacggagcgattctatttacaccgaacgcttccggtcagatcgagattccggttttaaagagtgtgctggagaaatacgtgaagcgtccgccggcacagggcgaaaacagatgttttgagtttcgtatgaaagcgaatatggaagaataccgctggtgtatctgtcgcgtcagggcagagtacgacggggcggatacacctgtttgtctgatcggaaaactggatgatatcaccaaacagaaggagcgggaggagcagcttctcttccagtccaccagagacggtttaactggcgtgtataataagacggcatttgagtatatgatggaagaaaccttaaaaagaggcagccgcggctgtttatatatgatcgatattgataatttcaaggatgtgaacgaccagtacggccatccggccggggataagattctcgttaaaatcggggaactgctgcgtgaaattttccgggattccgatttgattggccgggtgggaggcgatgaattcgtggtctattccgagtgcggcgagacgaaaacgagggcgatgaagcttttaaacggcacagaggattttacgaaggaaggcgaacaccggatttctgtgagtatcggaatcgccgcaagcaccggggagccggacgaagagtatcaggaactgttttccaaagccgatcaggccatgtaccgggcgaaacaggaggggaaaaatcggattgcctggtatgaggagtaggcgagaagaagagaagtaaaaagaggattgaaataaggataagaaaaaaatggctgcgttgaaaacgcggccattttttatgcagcaggcagtacgatgggtgaaatgataaggatggatttctaattctgatcgtcgggcagatctaccagagtgtaggcatggttgatgcagggtaagaaaatttcgataatgtccgaggtgcggatttttaaactggacgtattgatacagggatgacagccgagaaattcctgttcaagaatagcctggtcaatcagcaggcggacacgattttctttatcattcatcaggcccagaacagagacagagccaggcgttatgttcagatactcttccataaattccggttccgcaaatgagagtctggctgatccgatttgttttgacaggactgccgtccgaaattttttatgtcccggaatcatgagaagataaaaactgtttttctgagcattgcgcagaaataaatttttacagatatttgtgtttaaaagcgcatcgatatcacggcatgcttctatcgtagcggtcggatcatgatccagacgctgataggcgattcccagcttgtccaggagatcgtaagtgcgtatctctttataaggacgcccggcaggatttgcgggccgtccggtatatagggtgcggtctaagtgaaagtccggtatggaggtaacacgttctcctggcgtaatgtttgtcatatggagtgcctctttctgtttgaaatctgtcaaaggagtaataagaatcctggtgttattatactagagtgtgggaaaaatgcaagtgtaagcagagaggtaagcagaacggacggaggagacggacaaatgggccgtgaattgtaactgatacaggattgacggggcaatgtttttttcgatggttttatacagcgtcttgtattataataagttctatagagggaatggttatcgattgattgtaacgatagaatggcttttgctgaatattatatttaggaagttatcatatttggcagtttagcagcggaaagtgttggagggagccaaatacgccatgaacataaaagaagaaaaaggaaggcaaaatcaaatgattgaaaaccggctgaaagcggaaagaccgagagtagtgacagaaaaggcgacaaaaggaaagcgtgatgataaagctgcaaaagacagcagttcaaggcaggagaagaataaagcgtccaatacaggcaggaagatgggacgaaagccggattcgggggagaaatcgtcggatcagaaaaaagggcctaaaaaggagcaaagagcaggcggaaaaggaaactggggcaatgacagccagaaaccgaagtacgatacaggcaggaacagagcttctggcgggaactccaatttacagagcagggaaggaattaaagtggacaggcagccagtcagaaagaatacttctgcatgtcctgtgtttctgcgctgcggcggatgtcagcttctggatatgccttatgaaaaacagctgaagatcaagcagacaaagctggaggaactgttgaagccctattgtaaggtgcagccaattattggaatgaaggatcctttccattacagaaacaaggtacacgctgtttttgaccatgataaaaagggaaatcccgtttcaggtgtgtacgaggcgaatactcatcgtgtcgttcccgtagagtcctgtctgattgaggatcaaaaagcggacgagattattggaaccatcagaggcatgttaaagtcatttaagattaaaacgtatgatgaggacacgggatatggtctccttcgtcatgtcctgatacggcggggattcacaacgggtgaaattatggtcgttctggttaccgcttctcctgtatttccttcaaagaataattttgtacgggcattgagagaaaagcacccggaaattacgacgattgttcagaatgtaaacggcagggacaccagtatggtactcggtgaccgggagaatgtgctgtacggtaaaggctatattgaggacatcctgtgcggattccgtttccggatctcttctaaatcattttatcaggtaaattcggtacagacagaggtgctctatcggaaagcgatggaactggccgcacttaaggggaaagaaacggtgattgacgcgtactgcggtattggtacgattgggatcgtggcaagccaggaggcaggccaggtgatcggcgtggaattaaaccgcgatgcagtgcgggacgcagctcagaatgctaagatcaatgggattaaaaatgtgcagttttattgtaatgatgccggtgcgttcatgagcaggatggcggacaatggagaacacgccgatgtcgtctttatggatccgccaaggagtggaagcacggaagaatttattcaggcggtagttaagatgaaaccggaaaaagtggtctatgtgtcatgcggcccggatacgctggccagggatttggcggtgtttaggaagatggggtatgaggcgaaagctgcgtggggggtggatatgtttccggggacggagcattgcgaggtttgtgtcgaattgtgtcgaaagtagatgaagaataggaatgagtacagactaacgaggataaaaatagtgggcatttaaagaaaaacaacttatgtacagtaaagctaatagatcggacagctcattttcttgaccgaaaaagcgggacaagaaacatcggataattattaaaagcattttgttctggaggaggaagaaaacagtgccatttgaaaaaggtggaagagcagataaagaggggaataggtatgaaattaactgtataatttatgagattcttaacattttaaatgaaacaaattacagtgtagtagtagaagcacttggtactgatgaaattggcacagatatcctaataacaactcttgatggtgaaaaggaaaatcagcaatgtaaagcacgaaatgcaagtaaagagtattgggatatctctgatttaaaggcaaaaaatatattatctgcgtggaaaattcagttaaacagggattgtagtagaaaagtggcattggttagtccaatggcttgttcctttttatttgatttacataatcgggcatgtaataccagtggtatagcagaagaattttattctatacaaattatgaaaagcagcaaggaatttcaaaaattctataaaagtttttgttctgaaatgagtctaaatagcgatgtggatgctgatgttttaaaaagtatagattatttaaagaggatttattataagcagatatcagaatatgaattgcaagagcttatatttcaaaatatacaatatttattcagtagcgaaagaaaaacagtttataatgcttttctttcacttattgtcatggaagatatattgggaaaagaaattacacaaacagtattagttgagtattttacaaaacaagggattactttccgcttgaaagttggtgataaaaagatattaccgaggattagtgaggttaatcaagaatatagagagaatttcaggccgttacaggggggcttggtatttagaaaagagtttgacgattgcataaaggaaattgcaaatgaaaaatcgataattatttctggaaatgcaggctatggaaaaagtgggtgtacagaagcaattttaaattactgtgaggaaaagaatattccacatattgcaataaaacttgaccggagaataccacataagaactgtgaattttggggacaagagttaggctttccaaattcaattgcacattcaatacaccttatttcgagacatgaaaatgcggtgattattttagaccaattagatgctttaaggtggacacaggcatattctagtgaagctcttgcagtttgtatggaactgattaggcagataaaatatttgaattatgaaagaaagaagaaaatagttttagtatttgtctgtaggacatatgatcttgaaaatgataataatataaattcgctattcgaaaagcaggactcaccggagaatgattgggaaatagttagagtaaacgatttcgaagaagatgtagtaaaagaaatcataagtgaaaattatgagcaattgtcaaataaattaaaaaaattattaagaatacctagcaatttatatatttggcaacatttagacaaagaagaattctatggagattgtttaactaccagccatttgatagataaatggtttgagcaaatatgtaaaaaaggtgtagttgtaggattgcagcagagggtcatcaatgaaactaaaataagtatcgttgatagcttagataaaacgggccgtttatatgttccaaaacaaattttacatgttgaacaagccggtttagattatctgatatcatcagaaattattatggttcaagataataaagttggatttgtacatcaatcgattttagactattttatttctcagagaatgatggagaaatattttgatggacaaactatagaaaatattataggagaaaaagataaacaaaatcctggaagaagatatcaggtacaaatgtttttacaaaatgtattggaatatgacagtggagattttatttttgctggcgaaaaaatgttactttcagatagtgtaagatattatgttaaatatgttttttatgaaacattgggacaaattaaggagccagatgataatatctcgcaatttattattgataattgtgaaaataagatttacggaaattatttattggataatgctatattttcgagaaagcaatatgtggtaatcttaagaaatcaaggcatattagaacgatggtattcggagccggaaaaaaaagttgtagtttttaatttattgcagagcattagtcccaatttagatggagaggatatttctttcataaaaaagtatgcttttagtaatagagatgatgacgaacagttcatgagatgctttcttcatgatattacacaggaaagtgatgaaatgtttgaacttaggatgctgttttatgaacattatcctgattatgcaaaagaagtttatataaatgtaatatctatgatgaaacaatttgaaacaaggactatcagacttatttcattttggttaaaaaataaggttaaaagtcagggaagttacatataccgttatgaagaagaattagtagattcagataatccttttttaatagaaaattcagaatttgtgcttgatgaattactttcatatatcccaaaagaaaatggatgggaagtaaagtatagtgattggtcaggaaagtatatgcataaaagaaatattgaaagagcctgtgttgagttagtcaaaaaagccactatagcattaatccgtaaatctccagatgctttttgggaatattatgaattatatatggggaagggatattatgtatttaatgaaataattttgactagtttagcatatttatctcctcaatatagtaatcaggtaatacgttatcttagcatggatttgaataaaaatatttttgattataccagtgggggagaagatgaattggggcttgtaaaagaagttttgaaaattcatgcaatcagatgcgacaaagaagaattatcagtgatagaaaatgtaatttgcaaatatatttcgcccaatgcgtctgaatggtataagagaagaattgaacagaacaaaagtaaagattataatcctgtatattggagtttttggggagatttgcagtataaactgttacaatgcttaccagaagataggattagtaaaaaaacaaaagatttattgcacgtacttgataggcgcttttataaagtccagttacgttatggtaatctgaatggtcatttaggatgggtaaaatcacctgtctcaggaaaaaatattggtaaggcacagtggcttcaaattataacaaacaataaattaaaaaatagaaaccatttcaattcggttgaagtaaaaggtggatttattgaaagttcctataaaatgtatgcgaacgatttccaaacagcagtaaaacagcgaccaaaagaaatgatagaacttgtcttagagaataaggaacgggtgtttcctgcttttattgatgctatgtttttgggtgtggaaatgtcggaaactctggagacagttgattttaaagttatagaaaagatgttacttacatttccgtgtgatatggaaacacatagagcttcgtatttctgtggaatacttgaaaaaataagtaattattgttggtcatcagaaataatgcaacaattaaagaatattgctttaaaacattgtaatccagaactgaacaaacccaatgtaacaaattctgaagatgaagaaatgaaaagctgcgaaatgttacatagtaatgcattaaactgtgttagggggagtgccgcaagaacaattggacattttctctgggaagatgaaaaactatttttacagtttaaagatgttattgaaggattgacaaaggatgaaaatccggcggtgcgttttgcggccttgtatgctttatggccatcctataatattgacagagagtggacagaagaaaagatcatatatttatatgagttagatattcgaatggcaagttttcatgactcaaaagatatgttctttcttctgtatcctaaatacaaagaaaggattattaatattataaagaaatgttttgaatctgaggataaacaacttgtagagataggaggtcatgctgtttgtgaattttatatacgatatgctgaatttgaaacgattatattgtctgtcaaatctaatggcgaagatcaaataagggctatattggatatggcagtaatctatttgaatgttaacgattatcgggagaaagcaaaaaatataattcttaattataataatattgatatggatgtagagtttccgttatctagaatattctatgataaatatgttgacgccaagcacgatagacagttcttgcgagagtttatgaaagctaagataagcagaaggacagtacgggcgtttattcattatctagaggaaaacgcagtttctattgttgactatgcagacattattatacagctatgtgaaaatattttgcagatgaaactagaagatttgagaaagcaatggggtatagaagatgagatttcaaaattaattatatctttatatgatgaaacggctaattctaataaagttacagataaacagattgctgctaaatgtctggaattgtgggatataatgtttgagaggcagttaggttcagtaagagaggtcagcaaaaagttaatggaacggtaaacggaggatggtggagtagagtatgacgcttccgccaaggcaaaactgcgcctttcggtaatctttttcacaacctcaacacatgtggaagtatgttgtttgatatcacttgtggataaaaagaggaaataaggtaatgaccacaagatgtagtagtttgaaacgcaaaaaaggcaaaaaattaagtggaaatgcactgtgtttttagaatgaaaaattacttttagtagatatcaggaggatatttaaccgtcttagaccattcgaaaagtatttttgctataaaaagatatgtggtaaagggaatttggtgagatatgttgaaattcgattatctggttatcgtttcgataaccagataatcgatttttttgaaatagatcaggtggctatgtttcgcttgatcttttttatttggttactacttgtaaataacagcgtgtgatgatgtaccctggtaagcattatcgaacctgaggtgcttttgttcaactgaaaattccggaaacagtctagatgaactaaaagactaattatactataaattagttaaaatacaaaaccatctttaaaatacaaaattgatggtgaaatataaggatgatatactcagaaaatctattggaggcttatactatcttacacgatacatggaggtatctatgaaaattgaatttgaaaaaaatgagttctggtggggaggaatcgtgcataggggcgttgaaatgccgattaacgcgaatcagcatgctgtaattgattttggagatataaacacgccaaatcaatcgacgaatctgttgttgtccagtaagggaagatatttatatagtcaggaaccttacaccgctacatttaataatgggacagtcgaaatagacagagagataacgtacagggacggttatgcgaatctgcgcggggcctatctggcggcgatgagagcatattttccatttgaaaattgtttgccggatcagcatttctttaccatgccccagtataatacctggatcgagcttatgtatgagcagaaccaggcagatattataaagtatgcagaacagattattgaaaatgattttccaacgggaatactgatgattgatgaaggatgggctgaggattatgggagctatgaatttcgaaagggagcatttccagatgcaaagggaatggtagaggagctgaaacagatggggttcagggtcatgttgtggatgacaccatatatatcccctgactctgcagcttttcgggagatcgagcctttgggatacctgattaaggatcacactggagagacagccatcagaaggtggtggaacggttacagcgcggtgctggatttgacgaatcaaaatacatgtaactggttttaccataaactgaaaggtattatgagcacatacggaattgatgggtttaagttcgacggaggtgatcccaatatgtatcgggacacagatagaattgcggtaccaatgtcctcatgggaacagatgaaaaaatacggcgaagttggtttgcgtttttcctttaacgaattccgggcggggtggggactggggggaaaacccttagttatgcggctgtcggataaaaatcacagctgggatgagaatggattaaacatgctgctgccaaactctttgattcaggggctgatgggatatgcataccactgcccggatatgataggaggcggagagtaccagaatttcaaagaaaacagctgtaaactggatagagaattaatagtccggtatgcgcaggcagcggcgttttgtccgatgatgcagttttcagcggcaccatggagaatattagataaagaacagttagatattgtccgaacagctgcaaaattgcacgtccaaatgggaaaaattatactgaaattggcagaagaggcgtccaaaacgggagaaccaattatgcgttcgatggagtatatgtacccggataatggatacgaaaggatcaatgaccagtttatgctgggggacagaatactggtcgctcctgtctgcaaaaaaggagtgataaaaagaaatgtttgcctgccggagggcgcatggctgacagaagacagaattgtttatagaggcggcagaacaatagagatggaatgtccaatggacaaaataatatggctggaaaggaaagaggaatagtaacatgtatgatatgtcagtagatgagcttagaaaatatatggggtctacgccgaaagcaaatgattttgaagagtattgggaacgcggtttgcaggaaatgaggagagtggaggcgaatattgagtggaagaaagcagatttcacagtgccatatgccgattgctttgatttgtattatacaggtgtaaagaatgccagaatacatgccaaggtcatcatacccaaaaagaaggcacggctatttccagcgttattaacttttcatgggtattccagcagatgtgggtcctggacgagtaaaatgcagtatgcagcggcaggatttgttgttgcagcaatggattgcagaggacagggcggtgcttctgaagattccggtggggtgaaaggaaccacttttcaaggccattttatccgcggactggatggcgaggcagaccatatgctaatgagaaatatttttctggatacggcacagcttgcaggaattatcatggagcttccagaagtcgatgagacgagaatcggtgtatatggcggttcccaaggaggcgccttatctattgcatgtgccggattagagaggcgtatcagcaggatttccgtgcaatatccttttctgtcggattataaacgggcgttggaaatggactcccctgacagtgcataccaggaactgaagaattatttccggctgtttgatccacagcatttgaaagagagagaaatatttgagcgtttgagctatatcgatgtacagaattttgctggaaaaataaagggtacagtacagatgggggcttcactgatggatataacatgcccgccttccacacagtttgcagtatttaataaattaaattgtgagaaaagcatttatatgttttatgagtatggtcatgaaaatttacctgattatgatgatatggaaatgcgcttttttctaaaagactggatttgacgaggagtgtataatgtggaaaagatgagtgaggaaattgttctgaattatcatacatatcccttagtggttggaaatgcagataaatatacgtttagcaattgggatatgtgcggaagcacggttttaatagaaccaaagattataggtgaaaattatactactaatgatatcaaatgggaggtgtttgatgagtctgtcgctgaagtaaagaacggacttgtgcgtgcgaagaccaccggttttacaactgtaagagcgagtctgccatcaggagcagcagcctgctgtgaaatagctgtaattgataatataacgcggactactacgctatggctggagctcagtacggatcagatgatactggaaagtggagaatgtgcggatattcttgcctttctttacccggaagatgtgctgaagaacggagcaatgaatcgaaatgtcctgtttgagtcgtcagacagggctgtcgcagaggtggaacggagtggtaagcttattgcagcttcagaaggaacggccgaaatcagggttgtatccgaggacataggacgtgaagcagtctgtaaaatacaggtgatttccagagcgaatactgagtactgcgatatcagagagattgtgttgaatgaagtgagatggccgaatagaaaactcccttgttgtgattccagccatgaactgacagtcggctgcagtgcctgtatgggaataagaacaaaaggagatgtgggaggggtgatatggcggtcttctaatccgtatattgcttctgtgaatgaacatgggaaggtgatctcacattctgccggtgaggtaacgatttatgcgacgactattcgcggaggtaaaagaaaggagtttcatttatcagtcaaacccgttgagattaatgcagacaagattatactgagcaaacaagcgatccgtatgtcggcgggagagcagcaaacggtctatggtctggcattacctgcagcatttagttctcctcattttcaatgggagttatcagattcggagattgctgagattgtttctataaaggagaatgagttcggtggtgaggaagtcgtggttcaggcgatgaaagaaggcagcgcttttataaaagcgtcatataaagaaataacggccgtttgcaccgtgcacatcggcagtaaaggaaatgtcgggaatttatgtgtagagccggaaaaaaggctgcagatagaagaggtgtacaggctgaaatacacatatgatgacggggatttcaatcatgaattacactggttaagtgatgacagggaatgtgtctctgtgaatccggaaggaactgtcaaagcgtatgctcctggaagggttcggatattctgtatttctggagacaatttgacaacagaagagaggtaccagctatggaagctgagccaagtgcgcagactggagcaggattcttactggtcagcaaagcttcagacgattttaaaccatgcagtatacggtgaatcagagataattatagaagcggaaacggatggacagcattgtctgagaaatctgcatattgtagatgaggctgtcactgctgacagtgtgatgctgctttggaaccgggcgtctttgccggatacagatgatttctcacactatcttgtaacctggaaaaagcgaggggaaggatattgtgatgagaacaaggctttaacggtcaaattaggatatacggcaaatgaactggagccagaaacggattatgagttttgtgtagcggcgctcgatggcgtaaaccgggtgattcgcagtcaaacggttcatgccagaacctcaaaatcatcaaaggtgattgatgttacgacgaaaccatattttgcagcggggagcggtaaaaccatagatacttatgcaattcaaaaagcaattgatgattgtccggaaaatggtacggttttgctgccggccggacacgttttttacagcggagccttgtttttgaaaagcaatatgatatttgaggtagagggcattctcattggaagtacggatccaaaggattatcctcctgttgttacccgatgggaaggctggaggaaactgacacagccggcgaagtgctgggtgaattccaccgatgcagtaccggaaaaccggatggcttatgccagtctactaaatgcaggcgtttacgacgaaggagaaaggggaaaaagcggcccatatcacgtggaaaatgtaattattagagggcacggaatgataaatggaaacggattcaaactggggtataatgaaggaccgaatcattacgatatagatggtggtcttcctgttcctttctccacccggatggatcctagcattcggggcagggcaattacgattcacaatgggaaaaatatttatatcaaagatgtcactgtctgctacagcccatcctggacaattcataccatttactgcagtcatgtaaccatggatcatataatggtgatttccaaggggacaggaaaaacaggggccagtgacgatatttgtattctgaatggagatggaattgatcccgattccagtattcatgtcaatatatttgactgtttcttttatacaggtgatgatgctgtggcagttaaatcgggacgtgacagagagggaaatgagttaaataaaccttccgcgtatattcgagtgacggattgtgccagtgtgggctcaaaaggagggttctgtattggaagtgaacaggctgcaggcgctcatgatattctgtggcagaatcttgtggtaaaagatattgatcttttcggtctttggatcaaggcaagcccttccaggggcgggctggttcaggacatcatgtggaaggactgtgtcctggaaggaacacagggaggtatctttttggaggacaggtatcatggatcaggaagtaatccggccagggtacttcccgaaatatgtcataacacatttcaaaatatttgctccaaacgtcagaaatattttggaattaaagttgccggattagaggacagttatatccatgatattttaataagagacagcttatttgaagaaatcttaagcgatgaggatgaggcttttgaggtcatttgcggacagaatattgtaatagaaaatacagaaattccaaaaggttatagttggaacattgatgaggtttccgttgttttaaatgatcagaaatgaatacgtagctttaaatggctgtgatatgtcataaaagtattgcagccattttcattgcaacaagtaaaaatgcacaaaaaatactgctgaaaattagctgtttatacaaaaaataggggcgatttctcaaaaacgaaacaatgtttaatttttaaaattgataaatgacaaaaacacagatagacttaggccatcaaaacaaatgcgaagtcgaatggagaatgggaggtttcaaattgaaaagtaaagaaaaaagagtaccagtaaaaagcatcaggcaggaaataaaaaataatttgtttttttatctgctgccgcttcctggaattatattcctgattctatttaattacgttccgatggcggggctgtacatagtttttgagaagtatacctatcagggaggattatttggaagcgagtttgtaggactaaagaattttgaatttttctttaaaagtatagataatgcattgagagctacaaggaatacgttaattattaacggatttagtattgttctgggaactgtggcaaacgttggtatcgctattgcaatcaatgaaatacgtaataaatggttccgtaaagttacacagtcggtcatgctttttccccactttatatcgtggattgttgtcggtatgatatcccttaccctgtttgacgaaaataaaggactgttgaaccagtttattcagatgctgggcggagatgccgtttcctggtattccaatgcgtcactgtggtggccgattctgatcttaaccagtgtctggaagggtgcaggatatggatcgctcatttactttggagcgctgacaggctttgaccaaagcctctatgaagcagccgaaatagatggggcaaacagatggcagagaatcatgagaattacgattccgttgctgaagcctacgattatattaatgttccttttaaatattggcggaatcctgtttggaagcgtggatcagatcatgggtatgacgaacttaaatccattgctgtttgaaaccacagataccatagcaacattcgtatatcgctctgcaattttgaatggacagtttgaatcggcctcggcgattacactgtatcagtcaatttttggctttattctggtaatggcagcaaataaactggttaaaaagtttgacccggattatgcattattttagggaggaaagatcatgaaaaagagacataaaaaaaaggaaagtctggtttgctatctgattgtcggaatcatggcatttctttgctttttaccgctgtggataacatttgcatcatctatttcaaatgaaacggccattgtgaggaacggattctctttacttcctcaggagcctaccctggaaacatacaggtatatactcaaggataagggaaccatgatcatcagggcattcggtgtttcgttcgcagttattttcctgggaacgctgtactcactgttcattatgaccacatttgcatatacggtagcacagaaaaaagaggtttttcgtttttccagtgcactttcattttttgcatggtttactactgtgtttagcggaggtattttaccatggtatatcttaatgacacggtattatggactgcaaaataatctgtttgcattatttgttccgtacggcatgaacgtgttttatatgtttgtgttaaagaatagctttaaggctattccggaagagctgattgaagcagcacgaattgacggtgcaaccagcatgaagatatttacaagtattgcgataccgctggccaaggttggactggtgacagtgatattgtttatgtcacttcagtattggaatgatttccatttaagcctttacttaatcacaaagtcagacttatacacagtacagaaacttctatataacatgatggcaaatatatcggcactactcagcggaacaaagtcagtcgtagaggcttcaaatatcacaattccttctaatacggctcgaatggtaatgacaatgctgacggttctgccggtagtagcattcttcccatttgctcaaaagtattttgtaaagggaataacggttggagcggtaaaagggtaaaaatggcaaatagataagatcggtatctttctggtaaatattcagccagtatgataaaattaattatccaaggaggaaaacggatgagaaagagagcagcagcgttgattttaagtgtcgtaatgactttgggggcagtacttaccggctgtggaagcggagggccccaggcaaacagcggcagtgaagggcgtgtcagtgccccgcgtgaggcggatggcagtggcagcggaaaagaagtggttagcctgcgcatgattatgtatggagatatgaccagcagaagagaagagtatttcaaaaaagactttcatgaggcagttttgaatgatctggggatagatctgacggttgaatttatgccatggggatcagattccacggttgctaccatgctggcaagtggagaatcatttgcagtatggaatattgtatcggcatttgattgggcagctaagggatatctggctgaaatagatgaagcattaattcaggagaaattaccaaatctgattcgggtcagaacagaaaataatggctttgagtgtgtaaaacataataataaaatttatgcggtcccgtttggcagcaagccctatgcgggtaggatgcagacaatagaagttcggaatgatattttaaagcaggtggggtatgaggcttctgagattaccacatatgatcagttaatgagtgcttttgaggcagtaaagcaggcatttccggatatgagaataagcagaagctcaagctatctatggaacgcgttaaacagcgaaacatcagaccagctggtcagcatcatgagcggtaccgcatttacctatgtggatgaactggagaataatgatacggtttacagtatgtatgaatcggaagcatataagaacctttgcaagctggttcgtcagtgggtagagaatggatatattctgcaggatgaaatcagcaatccgacacagggagcggctgactgggaagcggggaattgtctgacgatgtatggtactccaggcgcatggattgacagaagtctgcagggagctgtacctggagcggagctggctcttataaagattggtgacaatcaaaagattaaaaatctcgactacgactggggattcagtatttcagccaacgaccagaaaaatgtagacagatggctggaactatttgactggctatataaggatcaggatacctataatttctgtatctacggtgtggagggtaaggactgggaatataacgaagatgggacaatcaaaaaactggtgacggacagtttctttgacagctggttcatgcaggctatggaatataatgtttatgataaagaattatcaaaagaagccatagaagcctacgaaacgaatgacgatggttccctgctttctaaaacggcaggattcagctttaacagcgagcctgtggcgtcagaactggcaatgatgacggcagtatggactgaattgatagagccgatgacgttaggaatactggattacgatgagaattacgacaagatgatacagcaattgaaaaaagccggtctcgataagtatatggaagagtaccagagacagtattcggagtggtatgctgcaaatagaaaacagtaagggataggaggcagagcaactcacggttaccgtgagttctctgtatctttgtaccagtaaatggggttatcttaagcggtgatggggggcagtgtatgaaaagaagaatgagtacctttaaggacagtgtgaattcattagtaggtaaaacactgttctgcacaatctcaattacgatggcggtattgatgaccacatcagttgttctgtttttttggtttcgcagtcaaatgacaaaagagtatcagaaattgacaaacgcgacaattgcaaatattgatgtggtttttgattattatatggataatacaaaaaatatgatggttcaatggttctattcttcagatgggactgtctgccgtttgagtaatgataataatgtcagctccaatatgccgctgttgttaaatgttcagaacgtcatagggaatataccgtttatacattccctgtattttttaggagaaaacagggaagtagtatttgaaacaggtacggggatatcctacacaaaagatttaagcgatgtgcttccagaaaaactagcactgaaaaaaaacgttgtaaaaccgtttatatggctggcacaaaatcggtatcagaacaaggacgatgtggcgctgctcaccatgtattgctgggagacccctttggaaagtccaaggtttacgggagctgcggtcgttaatctcgatgcgggtgaacttagcaggagcctattttccgagaaggttccagaagatttagagatattcatcatggacgagtcaggtaatattatctgccatagcggcatggagtattatgggcagaactggtctgaccgagaagatattaaaaaaatattagccggtgaagaacacgtttttaaggccagccaggatgaccggctgatagaaaccagttggattaaatcaatgcagagcggtttctatattgtggcacagtcagaatatgtcaatgggattcaccggtttaatacgatcgccaatgtagtttttgtcgtaatgcttgcagcagcggcaattattattgcatttacatggccgctgtgccgtcttatttataagccacttaacagtatgatttctgatattcgaaaaaaaatcgctatggaagatcatggatataatgagatccaggtgttgaaccagtattatgagcagttagcggaagatatcctgcagttaaacgagaatgaagagaagaattttatagtgaaaaatcttttattggataatcagatcgatacggtgcagaatttattactgaaaaatcgtatgatatctgtgggtagagggtattttctggtgttggcctatctcactgatgataaggaaaaagcattaagtatgcaggagtacgatatgatgagaaaaattgtcagtgatattttttcttcaaatcttggtaatctcggctgctgtacctattttgaaattagtttgagaaaaatgctttttttgctttcagaggcagatgaacagagtatagatggatcggaacttttgtcaggcgttaagcagatcagaagatcggcagaagatttgatacataataaagtggtaatttacttatcggaccggtatttgggggactgcgataactgtgtacccgcgtttaaagaagcagaagagcggttaaaaacgaggagcatactggaagaaaatgcaggaactgagattggtcattataatcaggcaggcgcagcagaacagatgaaggcagcagaaaagcacgaaaaggaattccttgtctgtgcgaagaaaagggacagagagaaatatataaaaactttggaagcgcttttggataactgtaaggatgtccggtataaggagtttattgcattcatggtgaagctttcgctggaggtactccagcttaagggaaagaaactgaaaactgaggattcagaagagcaggagaagaaactgcggcagcagctggaaggtctgtctttgcgtagagaatatattgaatggtttgacgtacttttccaggaagcggatgttaaaatggagcagatcaacagctattccactgcaaaccagatgtctgacgctgttgactatatcagaaataattacgatgacagtatgttaaatgtaaacatgctggcggataagatgaatattagcgctccatattttggaaaactatttaaggagtttaccggctgtacggcactggaatacatcacaagaacgcgtatggagaaagcacacgatcttttgctgacggaaccagacaaagatatcagtaaaatcgcgtcggctgtcgggtatagtaataatgcctattttgcgactgcgtttaaaaagtattttggagtttcaccgtcaaagctgcgggactatcatgcagtctcaggaataaagacagattctgatgaatgaaaagggataaggtggaaacatggtttatacaagcattcgtccagggaaggtatggctggatacggaagggaagagaatccaggcccatggcggttctctgctttatgagaatggaacttactactggtatggtgagaataaagaaaagactacgggagaggatgctgttttacattgggggatcaaatgctatgcttcaaaagatttgtataattgggaagatcagggtattatcatcccacctgatacggaagatgagaattcgtcactccatccgacctccaagatggagcggccgcatattatttataataagaatacgaagaagtatgtttgttggataaaagttatcaatcggggtggttcccaaacagagacagtattaactgcagaccgtttattgggaccatatattaaggtgaaagaaggaataaagccgcttggaatgaatgccggagattttgacctggctgtagcggaggatggaaaagcatattactattttgagcggattcacagtgaaataatatgtgcagatttaaccgttgattatacggatgtaacgggattttacagtacgcattttccacacccggcaccgccatatgtaagggaagctccggcacatttcctgagaaaggggaaacactatctgctgacttcaggcacaacaggatacctcccaaatccgtcggaagctgcggttggcgacacgtggcatggcccattttatgtgctgggagatacgcatccggaagatacaagcaggacatcataccattcccagatatcgtctgtatttaaagttccggggaaaaaggacctttacattgcatgtgcggatcgctggatgccggatctgatggcaataaagtatgaagcatatcgtgacctgtttattaatctgtttaatgggatagatgcagacttttcaagtctcacaaaggatttaggcataaactttaaccgcgcgatccggaatacatccatagctgattatgtttggctgccgctgcgctttgcagagccggatgcagagcatccgtcagggcaggtatatatcgactggctcgatgagtggcggatagaggattacgagtaaagaggtgcgttgtgtcatatggagtattggatcaagtcgagtcatgacaaacttttcaggtacaaaaaaatgcaggaagagcaattaagtatcttcctgcatggtatccagtacaagctgaaaatattggcggctgctttcaatgtcgatagttatcagccgatgaagcaattcaatcaagcggaagggtggtattctgaaccctgaaactttgtatcatgaaaacggttaatcaaaaacggtaaaccaaaattggtaaaccaaaatcgataattcagaatctaacagaaatctaacatagcgtatggtattcttaatcagacttccagccatataacaggcagaattttgattaagaaaggggatttccatgaaaaacaggaattataacggactcataaaattgacagctgcggtattgacagcgtctattgctctgactgcctgtgctgcgccgggtacagagggaataaatagttccatagcggcagacattataaccagtgaaggacaggaaacagcctccgacagccctacggcagggcaggcggcagattatctgatgcaagctgccggaaaatacgggagggcctcggagcggtccgacgttctggcaggatttcaggaagaggaggcagtcacatggatacagctattggtactggcaggccgcgcatttggagaactgcctgctcctgaaggcgccgctaagctgatggcttcgccgtcggtgaatctgtcaagtgttccggagtgggctaaggcagagctgcagaatctggccaacggtgggatactggcgcctagcgatctggggcaggcggaacaaacagaaatatccgcagagcagaatacttcggtggatacagaaaaaccagctaccatgaaagatctggaaaacctcacatcgcgttttcacgcacggtttgggaccagtctgaacgatgatttttaccatacagtaaataaagagctttttgaccgtcttgaaattccagaaggggaaatgtttgcaggaggtgccagtacggtgaccgctaatacaaaccggcagcttcatgagttgattctggagctcacggaaagcgggaacgagtatcccaccggcagctccgagcagaaaatccgtgacttatatctaagtgtgctggatacagagcttagaaaccgggaggggataaagcctcttgaaaaatatttttcggcggttgacaacgcccgggactattccgagctaaatgccgccattgcgctggcggttaacgaactgggaaattccgggaacggcctgttcccgatgatcgcggtagccgacacggaagacagcagccgttatatcatgcagctattgaccatgccggctaacctgtctttggaagattataacaatgaagacagcgaggttctaaaggagtaccgggaatccataataagacagttaacggtcgctggagacagcctgcaggaagcggaacggcttgcaaacgccatcatccagatggaacgtgaacttgccggacagacgattgacccggaggaactgggagatttacagagaaaaccgaaacgatacacaccggaatgcctcgatgcgctgatgcctcaggcgagaccgtcagaattgcttaccgccattggtttaagcccggatgtagttatgcaggcgtttgatgagaaacaatttgaagcctttgccggctggtttactccggaaaatctggaattattcaaggcataccagaagatggcgctcctgacaggattcagcggctatttgagcgaagagctggcatttgaattctactatggacaggccgctgacagcgatgctgcgaatagtgcggttcagatgtttctatccgaagaattgggggaactctatgtagaacggtatttctcctctgaatccaaggcagggatagaagagatggctggtatgatgatcgatgtgtttaaagaccgtataagacgtctggactggatggaagtaaacacgaaacaggaggctctcaaaaagctggacaatattacgatcctcattggatatccggatgagtggcagaaaaccgatgtgacgattaagagcaggctggacggcggaagctactttgacaatgccgccgcagtgtcggcctggcaatggaagcaaatggttgagagacttaaaaaacctgtggattcacggcggtttccactggcggcttatacggtcaatgcggcagccaaccgaaataccaacaccatcatttttcctgccggtatcctgcaggcgccgttttacgatcctaatgcctcattcgaggagaatctgggcgcgatcggcaccacaatcgcccatgaaatcacccatatgtttgatgacggcggcgcacagtatgacgcggcaggcaacatcaggaactggtggtctgaacatgataatacgtattttaaagagctgtgcagaaaggcggaagcgtactatgatggatatgaggcgcttcccggcatatctgtgagcggagcggaaactctgagcgaaaatatcgcagacatcggcggtgttgcctgcagcctggaagtgctgtcaaagatggaaaatccggattatgacgcatttttccgcagctatgccggacaatgggcgcgccttggcagctatgacggtctggcggagatggcatcgagtgattttcatgcgccgaaccgtttgagatgcaaccgggtgcttgctaatttccaggagttcatggacacctatcatgtaaaaccgggtgacggcatgtacgttgctccggaggaacggattaaaatatggtaattgttttataatcaaccgtgttgggaggaactggagatgaagttattattagtggaagatgaggcgatgctgtcgaaatccgtttcaaaggggctgaggcttctggggtacgcaatagactgtgcgtttgacggagaggaagcgttggagctgtacgctctgaatgagtatgacctcatgattctggacttaaaccttccgaagctggacggaatcgaggttctcaaacggatccgtgagaaagatcaggacttcagaatcctgattttgtctgccagaaattcactggaggataaaataaacggtttggacagcggcagcaatgactatttgaccaaaccctttgatttcatggaactggaagcgcggatccgcaatttgctctggaggaatttcaaaacagacagcaggttccttctctgcgggcggctgcgtctggatacgggagagcggcaggcgcagtacgccgggcagacggtggttctgacgcggaaggaatacgcattgctggaatatctgttctcccggctgggggagaccgtaagcgcggaggaactgattgagcatgcatgggacagcgagacagacttattttccaattcattccgtttccatatccactccctgagaaaaaaactggaggcggccggagctggagaatatattgtaacgaaacgggggcagggatatattctccgctgcccggcggaggacgaatcatgaaaaagtacacacttcaaatcaggattactgtttttgtcggtctgatcatggtaatatcctgtttgctgctgactgtgaattcgcttgtttctgcccggagttattacggacattacgtggaactgctggaggaagggatgattgagtatgatccggcgcttcctgagggggaacttccgcaggcgcttaattctgaaagccggtatcaggatatcagccgaaggttctcggcccaatccgttgttgttatggttcttatcgcattcctggcgctggcctttacttaccgggccacagggcaggtgttgaaaccattaaaagagctcactcacatggctcatgagataaatgaacgccatttggataaacgcgtgagtccaaacgatgcccagggtgaggtgctggagttgactaagtcctttaaccggatgctggaacgcctggaagaggcatttctgatacagaagtcctttgcctccaatgcggcgcatgaactgaaaactccactggcggttatgaaatcttcccttcaggtattaaaaatggatccgtccccctcggaaaatgactattgggaatttatcaatgacacggaagaaagcctggaacgtatcatcaagacagtggaggggcttttggctcttgcgaatatggagcaggtggaaaaagaatcggctgtgaagctgtatccgctgatcgaagcagccgtgcaggagctttctgtcagggcagaagaatatggcgtaaccctttcaatcgctggcgataacgatttgcaggcacaaggcagcccaagccttctgtaccgtgtattttttaatctcattgaaaatgcggtaaaatacaatcatgacaacggaaacgtagatattacggtgaaacaggagaagggccgtgcctgtgttgtggtagaagacaacggtattggaatggatgaaaaagacctttcacacatttttgaaccatttttccgggtagatccatcgcgttcccagagtattcccggctccgggcttgggctggcggtggtcaggctcattatggaacggtatgatggagagattgaggtagaaagcaggaaaggcgttggaacgacatttactgttattttgtagatggaatagacttctaaccgtagtttgtttaatattgcaaagaataaagctcttgacgaaacattttgtgtcaagggctttattgttggcattatttactatcaacaataacatttctgtgtaaggagatgtcacgccatccccaaatctaaaaatctatgatataatctaaaagaatagtttgaaagggtagaaataaagggattcactacctatgttgatatggactgttacggtttcgccaagggagatttctactcttgcgacattatttttgtacacacaacacacgtggagacggtaataatgatgcggaaatatggtttgaacaaaaatagaggataaaaccacaacatatagtggcttttgcggaaaaatcgggataaaaacggccgattttgaccccgattttttggctcttcctcagaagagagacagataaaagaagatatggaataaaaataaagggctgaccgacagattaccaatttaaagtcagattccatatgtaccagattatctgccgccaagcataccgtaggggaattgaatcaggcagtaaaagcaatacgagaagtgagcgataggttggaaatgtcaaggaaaaagctgctggcttcactggaggttgaggttcccagagatatagatgctgtgtgcagagtgatgcgaaaccatggagattatgaatttttgccgatagatgatctgagcccagaggagtttgcaaagtatattttgagattccatcatgtggcaatcgaaccgaaaatggagatattctatgatttgaaggagttttggtaggcagaaaatgagggaaaatggccctgtcaattcttactatggtgttttggtcaataaagtccgcccgattccacaaatcaacgcagatctgcaagaattccggttctacaattcgttagccttgactgcttattggaatgacagggattccactttaccggttatattgggcggcgaaatggcaattttttataaagatatgatacaggagaagataaataaaagcttgagtgactgttcggagaagggactggcaatgtacctctcaattgaactgctgggcaagcgtttttttaccatgcccccaagtgttgaggaatgtgggggagagatatggggcgtccttactgtaaaaacatacggggaattaaatcagcgggaactggaggcattaagagaagagtggagaaccatggcagacggtggctgaggagaggatttgttttaccgcccgacactgaccaagcaaggtgaaatttatatcagattttgggatacagacaataatgacaatctgttcataaaaactgaggatgaatttaaacgggaattttcagatggtattcatccgggccagccaaaaggagaagtgaccgagaaatcggactcgccatttataagtccatacttttcagaattgaatggagcagaacaaatgttctgaaatgctattgcactctttttcatggtcctgtataataggatcagaagcaggaaggagaagtttgtgtgatacggttgtttgaattacgagatttagataaaataatagagatctggctggagggaaatctgcaggctcatgcatttataggggaagaacactggaagcagaactatgaatccgtcaaatcggttctgcccaatgcggaagtatatgtgtatgaggaggcgggggagatttggggcttcattggaatggacgctgattacatttccggattatttataaaagaggagtaccggggcaggggaatcggtcatcagctgattgagactgcaaagcggaagaagcgtctgtctctgcatgtatatgaaagaaacactggagcagtggcattttatcgggcagaaggttttacggttcaacagagcatgacagaaaaagagacaggggagagcgaattcctgatggtctacggagaatcagagtagaggtatgttcggaaaactatagtagaaatcgttacctgtgttgtaaaaccgtgggggtggtacgatgccaacgtggaacccttggcatggctgtaagaaaattagtccgggctgtctgaattgctatgtgtatcgcagagacgcggaatttggaaaagacagcagcattatatcgaaaacgaccagcttttatctgcccgtcaagcgcagccgaagcggtgagtataagctccagcctggaggagaatgtgtctatacctgcatgacctcggatttctttctggaggaggccgatgagtggagacccgcggtatgggacatgatccgggagcgcagcgatctgcagtttgtgattattacaaaacgaatccatcgcttccgtgtaggacttcctgaggattggggagacggatataaccatgttaccatctgctgtacttgtgaaaaccagaagatggcagatgccaggctgtcgcttttcctggaattgcccatccggcatcagactattatccatgaacctatgctggaggcagtgaatatccgcgagtacctggctggcggtcagattgagcaggtaacctgtggcggagagtcgggaccggaggccagaatctgtgattttgcatgggttttaaatacaatgcagcagtgcatggaatatgatgttcctttctggtttaagcagaccggagcgaatttcaaaaaggggaaacgtgtgtattgcattgagcgcaaggatcagatgagccaggccgagaaggctgggattaattatagatatgaacataggatataaaaagaggtgtaagaacagatatgactctggaagattttgttcttagcttttgttaatagacattgcttttcaaacgaactaagaatatgatagttacgacagtacggacgtagacaaatttcaagttgaggaggatttaaatgccatatataacaatcgaaagcggagttttatcagatgaacagaaagaaaatttaattcatcgtttaacagaagtgtcatctgaaataatgaatgtaccacaagaatttttctcaatcaccattaaagagttaccagataaaaattttggtattggtggaaaaacaatagacaaagtaaagtccgagtacatgaaaaaacataaataaagcccaatttatcgaactgaaaaaacagtatttgcggaggggatgtttttatggaaaaaattaaaaaatacaagaatagtatttggagagttcctctgatttcagtaattgctggctttttctataccccaatttatgtaagaagtgtaattcggtttggcgtaatcgaacccggcgtgattgacagccgggtatcactgctcataagtgcagggatcttagtagcggttttggtgttgggtggaatgctgctgcttcggaaacagtcaaaaaaggaaatatttatttctgcggcagttgtttctgcttatggaatgatactgcttctgattcaattactcatcggagcaacaacggggcctgctgcggttgtatttatgtacttgggacggccgttggaatggaccggttttttctcggagctttctttctgcttaaaagagcgctttgaaatttttgtttctgcgattgggtggatgagatttttagttccctttgcgtttgtgttattcggttgtaaaacagatgaataaaaaaataactttggaattggtaggaggaaaaagatatatcatgtctgattatattgtgaaaatcataccgacagacttcacgtattctgtgacaaaggaacaggctaaccgcattttaaagttcttaaggtcgaaggtaaacgccgacaatatacaggctttaatacatgcaactcctacatttgttgatagcggaagcaatctgaaaacaattagctgccctcattgtggagagcagcttgactttaactggtgggggaaagctatggatgctgccagcaaggacaacttcaaggagctgtctataaacatgccatgttgtggtaaaaagagtacccttaacgatttgcattatgatttactgtgtggttttgcttgtatagaatttgatatacttaatccatctacggattttgacaatgaaactttatccaatatcgaggatttgattggcagaccaattcatatggtacacgcacatatataactcctggtttgccgggcttttaaattagaatttgtagaaaggggcgagcagctatgaaaatgtcaaaagagaaagttgatataactatgttcgccctatgtggaatgaattgcatggtttgctataagcactgttaccataaaaaccttgcgctggttgcttaaatagcgataaagggaagccagagcattgtcgcaaatgcaaaataaaggattgtattaaagaaaaatcgttatcctactgataattatattaataatcagaataacactttgttttttcctatatcaacaggtattcttctcatgatattaccgaataataatacacaattaattgatttttgcgattatgcagactgtgttctagatggttcagaggaactttttaattttcataatcggggacaaatgatgcaagcctcaagacaagtatttacgtgagtatggaaatttaatttaataatataattgagtggattcacaacatcatactatgcatatcgaagaatttaagaagcagaaatgaattcgccaaatatcttttttgctctatattttgaagattctaataccaaattgatattagaaagaaaatcggagcaaacgaatacaaaggctatgattgtataatgtatatatgaagaagataataatacattaaatataaatgcaatcgttttttcagccctgcaatgttattttgaattatttaaaacagattcattaatgaaagttgaaactgaatttcaccataaaaacgcaaagaacaggagataaacagtatgaaccagggttttttagaacaagagtcaaaacgggtaaatgaggctgtaaggaaaacacttttcagatcgttctttgcatacgtctgtataattgctgtcctttattttcttttaaaggattcctttgatttgaatgatccttccagcagagaagtgcttttttatctggttattgtctctgggatcatgctgcttgctgtaatcgtaggattttttaaatcaagacgagcagtcacgaatgggaaaaatctaattcttccttatggtgaaaatacaaaggggcagtggcggagcttattgatcaggaggcctcagagggaaagattcaggtagaagaatacatttatgaattcgcggaggggaagaagccatatggtgagaaaatcgtactgatgccttcttatctgctgctttgcggaaataaaaataagataacggtaattcctcgtgataaaatctattggatcgttgcccaggttggtcaaaagggaggttctttccgtgtacaactgttaatttttacagaaaagaaaattttcaatatggtaggagttgatatcgagcacgttgaggggattgccgataagatatatcaatacataccaaatgttttcagcgattacgatccctttatactgtcatatgaactggaaaaagtatttgcgaaagatcgggcggagtttttaaagttctatgaaaatgaaaagatgaaaaagaatagaagcataaacgaataaaagtatgaacaaataaaagcataaaagcatgaacgaataaaagcataacaaataaaagcaaaatcaaataaaagcaaaaacaaataaatactcaaacgatcacgaatccatccacaaagatagcctgttcataatttaaacggaggtaagaatgaaacagacatttaccgcactagtcgaacgttttgaagcgcagggaggctggtactatgtttcggttccaacgaaaatcagcaaaccactcgaattgcttggtggtcaccggtttggttttattgcggttactgccatagttggtaatacgagttggccgacatcgttcatgccgaagggggatgaaacgcatattatcgcactgcccgcgaaagtgcgttcaaaagagaagatcactctgggtatggagattgagatatcttttgaaacgagggtaagagaaagtaaacaggaggtattcatataatgtctcctgctcaatagaatcgtatgcagtatggatccggactatgaaatgagtgtgaataaataagaaaaactttggttctcgaaaaacagagccaaagtttttcttatttatactgcaagttgatctaagaatgaagccttactattttttactctataaatttatataattgaaagtgtcagaataatttgaaaaaaacctgattttgagctatactatttagtaacaaataatgattttttgagggaaaggtatgaaaaaatataacataattttaaatcgctccgtttatcccaaagaggcactgttaaaagcggcgtatgcgtttatcaatgaatgctatattcatttagaacaggatgatactcattatgaaatctcattaaccgcaaaggaagatggcgatctggcagatacacttccggcggaatttgaaaatgaactgctcgcccagactgtacgacatcaggtttactgccagacacatacggtcagggaaatactgatggcaagggcgatggcttcaaccatgattatggatggggatcccacggaaatgattgcagaggaggacgcctgttccaatgaggaactggagtcgatattggaggactggtttgaccatgaagcatgaggagagcatgagtttaaatctggaattgtattcattaaagataattaaggttgcagcagaagaatattcaaaattttgtaaggtaaatctgtcacagtccagtggcagagcagtttgctcctttcgttcacacgatattccggctgatctgattgcactggaatttggaaactatctgattgaactcatgcagcagggagaacaggcatgatttggatggaaggacttatggtgactcttgtcgtgtatacagcggcagcggccagttggtcagactgtcggcgagccataatccctaatgctttgattggccgttccatagctgtggcactagtgctcaatgggctttattatggaatctgggcgcatgaatacatacctttgtttgttacaaatctggctggtatgacggcaattgcattctttttttatgcgtatcatttgtgggcagctggagacagtaagatgctatttgtaattggacttggtattcctgccagactgttttcattttggaagctgggacctgtgccgggatttgcaattctggttattatattttcggttgctttccttactatcattgttgattccctgatacgcggaatccgggataaatcacttctgcatatcaatgcaggaagagtaggcgtaaagagagtcgttttatcctacctgtttatggtagccgccatgagactctgcaatctggttctgatggtgatggcaggggattatctggcagataacagcttctttttaaccgctattgatttctttatcattctgaccctgcttcaggtaaggcagaaaatatctgaccggatcttttatgcagcaacggctgttggctgggcagtacttttagttttatatcttttgcattggatccgttttgatgggatacagtttgacttgaaaccatggctgatcgtacttggtgtcatgtttttgagaatcatcgcagagcgttataattatcaggaaatacctacagtaagcgtaaaagaacgaatgattccggctgctgtcacggttttggcatttaagaagtcaaaagtacgggggctgcccacatgtatgacagaggatttgcgtgcaaggctgacttgtgaggaggtggactcaatcctgcgctggaaggattccaaacagggaaagtctacaataattattgtgcgaaaaataccatttgcaatttttattacgattggtaccatgatttttttaataatggaggttatggcactatggcatattatataaaagattacagtcttggatctcgccaggccgttgtaaagcgggaagaatcgtcttgcgcagagagacagcaggctgaaaccatgtatatttatacagacagaattgtcttttccagtgaccagtcttccattagaatagatgaaaccatatggaaacggctctcagatctccaaagcggagatattgtaagtatcaatgaccgcggcgtctgttatcgtctgtatactgcggctgagggagacgcgactatttttatgggcggtaattgtaattctaattgtatgatgtgcccgtcatcagactatgaaaggcacctggattataccaataacagggaagctcttttgagatttatcgatatgctgccggagaacctgccgcattatgtggttactggcggagagccgacgatgaggagcgatctgtttctggaagtgatggaacgcatggcggaccgtgtcccagaagcggatgcattaattctgacgaatggccgttcgttttcttccatgccatttctggagaagcttctgctaaagtgtccgccctatcttacggcggcaatcccgatacatggctcatgcagttgtgttcatgacgcgattacccgggctgacgggagcttccgtcagacgatgaggggaatccatcatttgttaagccgggggatttctgttgaaatacgagtggtggtgacgaaaatgaactgtggagatttggaaagggttgcagaactgatatgtaatcattttccgcaggttttgtgtgtgaatttcattagcctggaggtgcggggaaactgtattaaaaataaggaagaggtttatatcaatccatcggaatcattttgtaaggcgaaaacagcaattaaccgcctgattggctgcgggatcgacgttggtctctataattaccctttatgctgcgtggagcgggggtattggtttctttgcaaaaagagtatttcaccggaaaaagtgcgatacgatgaggcctgcgatgtttgtgaggtaaaagacatttgcggaggcctttttgtcagtactttaaaaacagtgcatccaacagttacaccggttacatttcatgcaaaagagaggaacatgcaatgttaaatcatttcaattttcaaaaaattgagaaccagatactgataaccaatgattttggaaagtacgcatttctaagtgaacaggaatttaagaagttgctccggggagatgtggcggaagaggatccctgttatcaaacactgaaagatggattttttttgatacgtaatccggcagaactctattctgctgaagcagtgactgcattgcggaagatgaaaaattaccttttttcaggaactgcgctgcatatttttgcggtgaccaattcatgcaacattaattgtatctactgccaggcaaaggacaaggcatcttcgctgggaggatttatgacgccggatacgggacggcgtgctgtcactattgcacttcagtctccctgtgatcatcttacatttgaatttcagggaggagaaccacttttgaattttgatacaataaaggcgatgattgaacattgcgatgcggtgaaaggaaacaaaaaggtagaatatacgctggtatccaatctggtttcgctgacagatgagaaactgaactacctggcagaacataaggtttctgtgagtacatccatggatggcccaaaatatgtacatgattttaaccggagatatcggggaaatgccagcagttatgattatatggaaacaggactggagaagctgagggggaaaggaatcagctcgggagccatagagacgacgacacgctattccctgtcctatccggaggaaattgtggactcctattatgaacatggtttaccagggatttttctgcgtcctctgactcctctcggttttgcacaggctgactgggacagtgttggttatagaccagatgaatttttaaacttttatgaaagagctttcgagagaatattggaaataaacaggaatggaactgtttttccagaatttctggccacctattttttgaggaaaattctgcatggagcagcctgtaattatatggaactgcgttcaccatgcggggcatccatgggtcaaatgagttattattatgatggagatgtatatacttgtgacgagggaagaatgatttctgagtccggtgaccgagcgttccggctgggaaatgtttatcacaatacatatcaggaactgatcgaaaatccaatatgcaaagcaaccgcagtagcgtcggttatagagagcctcccctcctgctgtgactgtgtatatcagccatattgcggagtctgtccggttgtgacctacgcgatggagaaagatatatttcctaaagcaccgggaggctttcgatgttccgtttatcacggaattctggatcttattttcaaaaagataaaaagtcaggatgcagacgttctgaaaattttcgaatcctggttaggaggggagctaaatgaaagggattaatcaaaaacagggtcaggcagttgagccggatatggcagagaaaaagaagccctttataagaacagttttgaagggggcaggactcctgttcctgtttctgtttattacaggaatgatcggcaacttttctacacctgcaagatttacctcctcatcatccgtatatgaaggatttgataaggtggaactggaagaaggtgtctatcttggagatgtggtgggcagcctgtttaccggaaatggacaattccgttttcttgacgggactacctattccggagaatggcagaactcaaagataaatggggaggggtcctgcatttatccgggaacaggaacttatgtgggaacctatgcagaaggggttcgcagcggaacagggacatttacctgggaaaatggagattcctatacgggacaatggctggaagatgagatgtcggagggaacgtatacgtttgcagacggttctgcgtatatgggaaccttttcggaagggaagatattggagggaacctttttgtacgcggttcctcaggaagaacaggagatacaggaactgaaggtaaccttttcagaggggaaggcaacgagtgttatctataaacgttccaatggattctcttataatggaagcctgctggatcaggggagtgccgatattatatatgaaaatggagatacgtattccggttctgtaaataacggactgagggaaggcgagggcatctatacgtggatgcaggagggaagccagatcgcaaaatacgaaggaatgtggaacaataaccagatgaatgggcagggaacttattcctatacaggcgatgcatatccaacactttccggaacatttgaggcggggcttccaattggcagctgtacttatacaaaagaagcgggaaatacttttacagcttcttttgaaaatggaacctgcaccagtgtcgagtaaaaataaaggggagaaaaaatggcagattttaaatttccgcatatacaggactcaattaccaattttctatatgatgaagagggaaatatacccagaaataaggtactgacgatcggtgcaatgatgattgtacttggaatcttaatgtcggatgaggcgtttgcagggcaccgttctcactcctctcaccgttcgcattccagtcatagcagccattcatcaggcagcggcggtcactcttcccatcagtcacatgcatcacatacttccagtactaccggtggttccagccattcttcgggttccgtggagacggctgcaccgcacagcaatcatgcaaaccatgtgacgcacagcaatgtggcaccgactccggcacaggccgctgcagtaaaggctcctgtcgttaccgagaacggtgtatctgaattatctgatattggaagtattctgaaggtacaggagggacaggcagtgttatcgactgttggtctggatatccagagtgttccgccaacaccaaaaattgattgagatcaggggaaaatattatgagtacagagaaaacagcagatttattgactctggtatcagcttgtctgccggatcataaacagttaaagcatgacagcctgctggaggatattgaagtcatgggagcgtatcaggacctggcgcaccagccagtctttcgagaggtatatgagcggtatttccatatggagcggctggataagatggagacagatcaattggaagaaatgaaacgcatacttcctaaagtgacggtgtgtttgcggggcattgtaacctcattgcagaaaggcgcggggccaacattgacggaagaagatatgccggatttttacaatgaaaataaaatagacaaactgctggaaaagctggcttccggaaatggggataattatactaatattacaccggatcattttatggatatcttttcaaaagacactttaaagtctggcagagagctttttggacgatttcaagtggatgaggatgactttggtaaagcaattcagtcggtaatgaacagtcagccttactgtatcagccgagatgagatggctcatttggaatcagagtatcagaatgcggtaaatgaagtcagcagcagggcaggcttttttaggcagggactggctcggcggctgacaaagaaactggtgtgctgtatttttgcatgtatgatgccggcgctggtggcttccatgacgggaaccatgaactcagccatgattgaaatgtccagaacgcttattgtaattgcatccattatctttataattgggggataaactggtatgacgaaagatgaaaaattgctagaggcaaaaaagagtgcagaagaccggcagaagaagatggaagccaggggacggcgcaggagatggatacagatcggttttccctgtgcagttgtggtatctgttttaataggcatggcaggaacaccctttagtgataagattgcatttgcatcgtatcgaaaaaatccaggtacaaagatcagtgaaaatgtgttccgaaacagggacggataccgtttatggcaggataacgcccttcacaatcatgtgagttgtctgatgggtggcggagaattctatgatgatggcgcaggaacaagaatttttcctgcttcggactgtagtcacatggagatcacgatggaaggaagaagcaggattttttcgaatagtctttgttcttacttaaatgtagacggagatatcgtttattatagaaagaattcagaccgatgtatctaccggtcctacattaccagtgggaaagaggaactattttattcaggtaatgcaggggaagtctatctgtatgataattatatttactttattgatctggcagacaatcgcgctctggtccgtatcaatacggagggggagggggaacctgaagttctggttgagaaagaagttgaggaattttttgtttatggcagccaatgtgtctaccttacgtcaggaaagctgctgtgttatcaggaggttaaggcggatgcagcctccttcgccatttctggaaggtatgactggttcttctttaatggagatattattgcgcagagcggaaaaagaattattgggtttgaaccgcaaggcggaaatcccagactgctgtatgaggacaaggaaaatgagttcaggctggtcggtgctggagacgaaagcttttatattcaagaggcagattctgttaaaaagataccagttgagcagaaaaaggccggaatcgtgacatatgaggaaaatggaggcagccttgtgacatcgcttcttgagaccgtggatggactgaatgcagttgtatatgaagcaggaggggacgtggtaagggtcagaacagccgaatttcgaatagaaagcggaggccagcaggagggagaagagaatggaagcgaatcttaatacggatatcaatcccagcgtgcaggaggaaagcggaaatgagactgttgtaaataccgaaatattgagcagtgaaccagggtttacagagattaatccgattgcgcacggaaacagcaccgagctttcggcggggacggtattgtgcggcaaatatgtgatacaggagatcctgcaccagaattccggagaggccgtgctttatctctgtacatacagaaacagacagtatgttgcaaaaatctataggcgggccgctgcaattaaggaggaagtcatcgaggcacttaattcggtcacctctccttatgtagcaaagctttatgagaccggattttttgaaggtgctccgtttgaagtcctgccgtattataaatatggcagtctggaaggtaaaactttttcttttgagacccttgaaaatgtaataattccggaattgaatgcgggtctgcatgcgcttcataaaaaggacattattcataaagatttaaagccggccaatattatgctgtgtgacaaccagacggatatcgcaatcattgattttggtatcagttcgatccgggaagatggtaatactgtggtcatgaccaggacgggaatgacaccggagtattccgcctcggagaccttccgtaatctgtttttggaggaatcggattattattcattgggaattacattgtttgaactgttttgcggaaagacaccgtatgaagggatgtcaaaagattccattgaacaatttgtgtcggttcagaagatcccgtttccggaggagatgcctgaaaggctgaaagaattaattacagggcttacctataatgatataacaaaccgaaaagataaaaataaccccaaccgccgatggacctatacggaggtcgtaaaatggtgcaggaaagagactctccccctgccgggaggaagcagtattaccgcgccggatataccgatacagccttatacattttatcgtaaaaagtattatcggctgaatgaactcgcttatgccatggcagagaattgggaaaatggaaagaaacacttataccgttcgactatgtcggaatttttcaaggccaataatccagatctggccaactgctgtatcgatgcggaggaaagcgttcgcatggaccggcagaaagcagatatttctttttttcgggtcctttatcagatggcgccggaaatgaaagatattttctggaaaagtgtcaattacgggccgattgaggaaatgggaaggaatctgatgaaagcggcggagatgggggctgatgagagtatctatacagagatgatcagagaaagagtattttcctcctatttttccagcgtatctccggagcaatcagctgtagtaaagggcgtggaagcaggagaacagaaatttattaattcaggcaatcaaaatgaacggattctgtcgatcatgctgattggccgttatctggccagagaagcctccttttcttgtggtgaggaaacatttgatactttggaagcgtttgcagagtatctcctgaatctgcgaaaagagaatcctgaacaactggaacgaacggcaaaggggattataaaaggaaagagaatgctgcatccatcttttgaatcgtggctgattttgctggggaaaagtacagaaatcgcagcctggagggaaagaaagtaagggagataaaaagtagaatgagtggtccgaagatttcaatttacacattgacgccggctcagctggaggtgctcaggcggcagatggaggaggaactcaagcggctggaagaagaggagcgtctgcgtcgtgagataaacaggatttttgtacaactggccgagggcagaaaatgggtggagaaaatggatgaagagctccagtcctataaagaaacctcccagttaatgatagagtggaaacaggatgcatcagttcaggccaggatttctgatattaagctgaagttagaaaaaattgtggagaaaattcgtgaaacgtacaggaaaacggatatagattcgcttcaggcaggcagagatctcattctgaaagacatagaatcggtcagagatgagatactcctcatgtcgtcttttgtatcagataaacgggaacagttagacgcagcgttgtcgggtactgtttcgactggatttgagcagtttatgggacagaagaagctttctgaacagatatctgcccaggaacaggaaaaactccagaatatagattttaaatggctgaaccgtattgatgaattggtttgtaaagaagtaaaaatttcttcagtgctgaaagaaagacttaaggcggcaggagaacaattgatgcacattacggattatgagtttgcatgcaattttgctgcaatcgaacttcagccgctgatagaacaggcggagaaggcacaggctttttatttggattatggtggtgaatacgagaggctgtcggcgcggtatgagatactttgcaaaaccttaaaaacagattcagagtcacatgtgtttccttttgatcaaaaaggattggatcaactgagcgcagagatttcccggatggagaaacagcgtctggaggcagcggagcgagagtatatcagtgatgagatgacagcagttatggaagaaatgggttacgatattcttggcagccgtgaggtgataaaaaagagcggaacaaaatttttgaatgagttgtatgattatggaaatggcaatgcagttaatattacatatgcgtctgatggtaagattacgatggaactggggaaaatggattcgtctgacagaatacctgataccagtgaaaaggctgttctggttggaaccatgacagagttttgcagcagattcagagaaattgaggaccaccttgcagaaaagggaattttagcggaaaaacgcctctctcttatgccgcctgatgaggcctttgcgcagattattaatacagaggattatatattgtatcagaataaaagagagaacgaggagaaacggcgtaaggagagaaatgttaagtccagatatatagattaaatatagaataaacggattatgggtgaaagaaaatggacgaactaaaaaaatataaggtgtgtccggtttgcggcggacataatgatccaagattgatggaatgtgatacctgcggaaccgatctgatgggaataccggtggtggatgctgctctggaaaaggtaaccgcgccaaaaggctctgcttatgtacgtatctgtgaatgcggccatgcgaatccttcccaggccagaaagtgtgaatcctgcggagaagatatttctgatattattcctatggaaaaagagtcaaaacagacgttgcaatacagactttgtgatttggcaggacagtatgagtacccaattccacaggggactgcggtgattggacgtgaacatgagatgcgggagtatctgtcagaaaaaagttatgtcagccgtgctcatgcaaaggtgatgctgaatgaagaaggcctatttattgaaaatctgagcagaacaaattatacgtatgttaacaatattcgtatctgtgatgggaaggtgcctttaaaaaatcaggatgaggtatcgcttggcggtatttccttaaatgggattcgtcaggagcaggccgcctatttccgggtggagacaatcgaatgaatgtggtcagagtgctgtatcctgtggaggtactggggccggggaaacgggcggcagtctggttgtgtggctgtccgcatcgatgtacaggctgcagcaaccccgaattgtgggagatgagaccggaatatgatatacagccggaaacactggctgaaatgataggagcggtcgtgacggatcagggaaaaagggttgatgggattacaattacgggaggagaaccattttatcaggcaggagatctcgaaaggctgttaaatcggttgagatgcttcactggggatattctcgtttatacaggatatacgctggaagagctggaggcaagtaaggatcctcgagtaaaacgtgctctagatcagattgatgtcctcatcgatgggagatatgaagaaaataaaaatacaggtgtggcaatgagggggtcttacaatcaacgaatttacgtacggaacagaaaactggaaggcgtatatgaggcataccggagtctcccaaatcgaattcagaattttactgcgttagaaggagtcatatctgtgggaatccattctccgggttttaacgcggaggtggagaagagggcggcggagaaaggaatggtgatgcagcgtggagagtcatgaatatatggcaaagtggcatcgggagctcgagatatttacaaaaatcaaaccaatcataattctggatgggaatgtcctggatgtctatcagtaccctgtcgatgggacgactgtgaaaggctctattgtccgccttacggattatctgtattacttttttatggatcgagggtataaaagtattgtggaatacgatagtcttcaggggttccataatgactgcaatccggatatggtagattctttcgcagaattgtgcggggcaggcggcacaagccgcaccatggcgagaagtgccggcacgcagggggccagccgcagtgtaccatccgggtattcaattgcagcgccgttcaaaggtgcgggtaaaggttcggcgcctgatcttatcaggaaaagtatggcgcagcatgagcggccgtcggcagttattctaaatatggcctcccgttatatcccaacgccggacaatctgacgcaggaggaggtagacagctttacttcactggttcatggctccctggaagcgaaggatgttagaagcggagatggaactctgaagaatgtgcttgttatggttgtaaacaagctgaacgatttgcctgcgtggttctatcttcagaatccgaatgtaaagacaatttccatcaataccccttctaaagaagagagagagctgctggtaaaaggtgataatttcgagacatttttcgaaaaaatgacttaccaggaagacaaagcatattatgagcagaatcctcaagaactggagaaaattcaggacaagtttgtggcactcacttcaggattttgttttacagagttaaatggattaagacggttgtgtaaaaatgaaagactgcatattcatgaaatgtgtgaggtgattgatctatatcgctatggaattcgtgaaaatccatggaagctgcttgatttagatgaaataagaaatggtaagacacattttgaggaacgggtgaaagggcagtctgttgcacaggaaaagacactggatattatgaaacgtgcgattgtggggctgtctggggcacagggctcgtcccataacaggccgaaaggagttcttttcttcgctggtcctactggtacgggaaagacggagactgcaaaaacactggcagagattatttttggacatgaggatcggtgtatccggtttgacatgagtgaatacagtcagagtcacagtgatcaaaagcttttgggagcccctccaggttatgtgggctatgaggcaggagggcagctgaccaatgctgttcgtgaaaatccattttctatcctgttgtttgatgagatcgagaaggcacatccatcgattctggataagtttcttcagatcttggaagatgggcgtatgacggacggccagggacggacggtctatttttcagagtgcatcattatatttaccagtaatctcgggatctacactgtggatcagtatggaagaagacaggaaaatgtgtccatggatatggcatacgaagaagtatctgccagaatacgttctacgattgaagagtactttaagttgcagctgggacgtccggaaatcttaaaccgtattggagataatatcgttatttttgactatatcagaagagatgtggcagatcagattttaaacagtcagttgaaaaaaatctgccggacaatggctgatgaaaagcagattactttagaagtttcggccgagagccgggaaacactgaaggaatatgcttacaggaatcttcagaatggaggccggggaattggcaatgtcgtggagagcatgtttatcaatccgctttcccgcttcctgtttgaccacaacgtatttgacaatgcccgtgtagaggtcctggcaattgatacgatgagttctccggcagtaatttccgggaagatccgtgaaaacgcagaggagggggagcgatgaaggtatatgcagcaacccagaatggtattcataaaaacaggaatgaagatcgtgttttaattggcagtacaattcttgccgcaggcgagtacagtttggaaatgccatctggaatcgttgccgttgcggacggtgtgggtggaaacagggcgggggatactgctgcccagtttatttgcaactgtcttgcaatgaaaccagagatatcggaaggatattttcaggcgattaatcagaagctgattgcaatagggggtgaacatgaaatctggaagggtatggcgacgacactttccggtatcatttttacggaatgcgggaatcagatctttcatgtgggtaataccagaatttatgctttacaggccggttcttatctgaggcagcttacagaggatgatacaacagtcaactatcttgtccattctggaaagatgacggaagaggaagcagagaattaccatgcgcgcagtgagattaccgcctgttttggaggcggcgatcagaaactgcttcggataaagcggaagaatatagagggaaatcggacttatctgatgacaacggatggagttcatgaaaaactgtctgttgacgatatggaagatttctttgcagccggccaggattatgctgccgtatgcagaaatatccttgatgcggcggttcaggccggagcagaggatgactgcactgtggttgtggtggaacagattatggagtaaaggatattgctgaggcagcaaaagactcgcttttgctgccatttttattccgtgtaggatttatttagaatgtaaaaatccgtttctctgtccatttaagccgaaatcccaaccttgcatcccccaacagaatatgctatgctgagtatgctcttacactagccagacatacgataccatgccgcgctgcgctgcgccgtcaaggcgccgggcatgcttatagggggtgtataatactgcagctaataataccatattcaggaaacaggaatgtatcctgttttttttgttcgcataggaaggaaaacatttcctctggcagattagagcgatgaaagaatttcacagaacagcagccatcttgaaatatgatgatgagactggaaaacttaataatattcctgttcataaacaagatcacgagagcgggaagattccatttacccttttagcggaagaattgaattgtgccaaaacccggaattgcgaggacgaagtataatatccaataaaagcggatggaaggaaatcaggtgtttaaatatccgggcgcaatggatatttgaattccttttttttatttgggtaaaataacaaagacatcaataatcattatcggagaccataatcggaggacatcatgaggaaaataggaaaacagcttattacgatagaactgattgacaattattgcgcgtggcttgcgggctgtgaaaagagcgagaagaccattcaaaaataccggtatcacctgatccagtttatgaaatatctggatgggaggccagtgacgaaagaacgggtattaatatggaagaaatatttgaggggacattacgcgccaatctctgtaaacggcgcgctgacggcgttaaatggcctctttcagttttgtaactggaaggactgtacggtgcgctttttaaaaatcggaaaggcttctttctgccaggagagcagggagctgtctaaggaagagtatttgagactggtcgaggcagcggcccaaaagggcaacgagagactggcgcttgtgattcagaccatctgtgccagcggaatcagaatatcggagcttgcctacatctcggtggaggcggttcagagaggcagagcggaggtggagtgtaagggtagagtgagaaccgtccttttgaccaaaaatctgtgcaccatgctccagcagtatgcgatgaggaaaggaatcacagagggggcaatattcagaaccagaaacggaaaggtgctggaccgcagcaatatatggagagagatgaaggcgcttggcgcggcggcatgcgtggaacgtgacaagatattcccgcataacttaaggcacttatttgcaaggacgtactatgaggctgaaaaggatctgtcaaaattagcggatattctgggacatcaggatattaatacgacgcggatctatacgatggagagcggaaacagacacagacagcagctggagaaattagggctgttggttacatcatacaaccgattatctcttttgttgtaaaatatagaaataaaaattagaattcatcctgattatactacatattaattttaaaatccatattttcctacattaatttttgtttttcgacacaaaaagcagaccgaacaaattcaaaatttcgatctgccttataatcatgcaattttttgatcgtttctgcggtttaatacgcggaaacgatttttttttccttcttcttccaatattttacaacaaaagagatattcggttgtaaaccgggacggagaacgaaggatgaggaaaatcagagaaccgtgtgctaccggtttatcggggaaatcacgcttggaatcgggtatggattgatgggggtggaaatattgcgatattacatgggacaagagcctgggcggacacaggtggaagttggtcccgtaagaagagatggagagagattccatgcacgaaaagctgtgaccggacacgggacatgccgtggaacactatcgagccggaagtgccgcaggatgaccgaattcagaaaagcggagagacggcggcgggttcaaagacggatgatgaagcttgtgactgtgatgagcacggtggtggctgtcctgacagcgggatattccttcgtttccgaaggggcgctggaaccgaaggaaattctggtaccgcccctcgtcatcaccgtgtccgaggaggaagctcccgtaggttcggggcctccgccggcagccatggaggagtccgcccagagcacctctgaggccgacgccattcctgcaccccccacatacctcggagaattcgagatcaccggctactgcagctgcgatatctgctgcgggaaaaaggacatgaagctgacaaagatggagaccgtcccgaagtcaggctataccatagcggtggatccgcaggtgatcccgctggggagttacctcgagatcgagggagtgacctacagggcggaggacattggacaggcgataaaagacaggagacttgacatctttttctcctctcacgaggaggcaatcgagttcgggcggcagaaaaaggatgtgtatttaaaataatccctttcgagggtttacatagataaacaaatgaaattggaaggataacaggatgaaaaaaaggaagattgcattgacggcggttgtacttgtaacggctgccatactcctttcggaaactcagaccggaattgcatatgcggtggagggctgggagagtgccggcggagaatggaggtatttagatgaccaggaccagccggtgactgatgtatggaagcagtcaaaggaagcctggttttacctggattcggccggacagatggtaaaggaccgttttattgaccggggcagcggcctgtattacgtggacgcagatggaagacgcgttcagggcagctgggtctggtcagatggaaaacggcaggaaggttatgaggaaggctggtactattttggcggcaatggaaaggcataccggagagccggcggttttaaacgtgagataggcggaaaaacatacgtgtttgatgagagtgggaaaatgctcaccggatggctgaatgaggaaggccgccctcttacagaggacgagaatccattgacagagggcgtgtactacgccggtgaagatggggcgctgtggagcagcacctggctggattacggttccatggagctgggcgccgccgatgaattggaaagcagcgtaacgggacgggattacaccgagtataaagagctgtggctgtattttgacaacaactttaaacggataaaaagcagcggagacagggtgaagcagaaggtgatcaacggcgcaacctatggtttcgatgaatacggcattatgctgccgtggtggagccaggtagccagtgtcagcgacgcggacagaagcaaccccaccagctcggaatctgcaaaatactttgcaggctatgacggcgggcgcctgctgcgaaacacctggttatggatgtgcccctccgaaaatcttgacgaacaggattacagcaacggggaatacagctggtggtataccgatcaggacggagaggtttaccggaaccggatccgaaaggtcaacggcaggaactacgcgtttgacggactcggaagaatgcgtacgggattcgtgctgtttgatgggaaagatacctttgtagcccagtatgacacggatgactggacttctgaagattttaaaaacggagacctttacggattggaaaaggcggatttgtacctgttcgcgccggatgaactgaatgacggttccatgcagaccggcggggatataaaggtggagctgtccgatggagtctttacctttggatttggaagcagcggcatcgcttacggcaaccggaataagattcgcaaatggaaaaatgcctactatattaatggcctgaaactggaagcggataaagagtacgggtatggcgtcgtttgggaggacgaggatatttaccgggtggtcgataccaggggaaatgtggtatccggacagaagaaggtggtaagagacagggacggaggctggctgatcatcctgaacggacgttttgccgccaggacagacgacagctcaaagccgaagtggcataacggcgaggaaggcgagggattttaccactacgacgggagcgatagggacgataagtattccggaggcctcattgccggatacgattcggagccggttctggatcagctgcccgccgaggaacgattgaattttgagtagaaagaggttggagacaatggatggatttcgaaaaggcagattgccggcagttatgagaagactgcttcggaacgtaaagaggggcaccgcactgctgctggcagtcaccctgacccttttgccgtcggtaccgggcacggccatgacagcctgggccgcgggcacagagcttcagcctgcacaggggatgaagaccaatggcggcggattgacgactgcttataagtggaatcagggatctaccggaaaatttgacatagaaggcatcgaaaatgccgctttaatcggttctgataatccctacacgggagacaggtcaaaatctgttatcaccacgtatgcccaccagggatatgagacggtgatacagaaacagggcggcgcaggaggaagaaagaatgtagccatatcaaccaacggcggagtgcagacgtttgacgacctgggggttgaagtacagatgaaggtctaccccagtctggatcagaaatggattctggtggactacattgtatataacaaaaccaatgcggataacccgattcagctggccagcggcacggatgttcaggtgggcggaagaagcggagcgggtgcgggagacccggcggacgcctccactctggaagccaatagccgcgggtttcacatggtcaatgaacagacgcagcagacctttgactgtatctacaatgacagcagtctgggggtgacagagcctacaacgaaatgggtaggtcagtatggcagcaggtttaatttttattttacggatggaccgcacagcgtttcgaatcaggattcagggcttacctattcctggactatcccgctccgcccgtatgagacggcagtccgccgggtggcgtttggagccaaagggccgtcctactatgtgtcggccgcccacggaaacaacagcaatgtaggcgcttacgatacaccgttacagacgattgaagctgcaatcaataagattggcagcaatgtaggctatatctatatacaggattacggcgaactgacgtcaacggtcaacattccgtcaggcgccaatatcacgtttatgagctcagattacaaccgctcaggaacgccgatcgacgatatcatcacactgcacagaagttccagcctggtgtcgggaccgatgttcaataccaacggaggcaccatgcgtttcagcaatcttgtgctggacggcagcaaggccggggcagcaggcaataccgctccgatcctaaccggaaacaccggaacgatcggtgtgatgagcggggcggtgctgcagaacaacaaggtatccgcacccggtgtgggaagcgccattcaggcaggcggaagcgtgaacctggagatgaatttcggaacgattaccggtaatgtcacgaaggaccggggggccgtgaattttgaaagcacagggaaatttacggtacagaaccggatcgtgattgaggacaatacgaatgaaggcggcgcaaaggccaatgtctatctggccgccggcaaatacatgacggtagagagcgacttggataccacgagcatcggtgtgacgaccgcccagctgccggaagcctcggccggtggcctttctacacaggccaatcaggaagtaaagatagctgtgccgctgacgggaagcgcggtgaatatatcgcccagtccgtttgtggataactttttcgcagatggagcaggcagtgacggaaccggactctacataaccaccggcacggccaatttaccgggagcgggagcaaaccatgacagaaacacggtattgaagaaaaatggctatcagattacatccttcatcaaagatgtaaacacaggcggcggcatcacaggagcgcctgcgataccggcaattacccgtggatcgggtgaggcggtagagattgccgcgccgccgcaagtgacaggatatgaattagaaggcgtgaccattgatcagggggcatttacctcgcttcaggctcagctcacaccgggaagtgattttggaaaagtaacgggaaccatgccgaaccaggatgtgacgattgactacgagtacagaaaggtggattccagcattaatttcgaggcaaacggcggaacgccgacaccgccttccctgacaggaatggccggcaacagcgtcaacgcacttctgcccagcgtcagccggtatggctacctgttccgcggctggagtacggtaaatgactggaataatccgaactttattaccggactgccggcagtatttccggatacaccgattacgtattacgcgatttttgaatcggaccccaatgtgaagtttaactatactgtggaatactccaatcagaacggatcgattgtattccagaccaatacttcagaaaatgcatacagtgtggaaacgccgatccaggcacagaagaaaacgatacacggctatgtatggaacctggcagactcaggaacgacgccggagacgtataactttaacgggaccagcgtcccgattggtacgtttaacgggtcaggcgggcagtttgaaggaaagatgccggggcaggatgccacggtgcgttaccgctaccgggtggactacggcaacacagccgcgcagtcgcagcttacggtacgccatcagactgcgggaggagccgtcgtctcggccgatcagaccagcggccgctatccggaggaggcgattaccgccgctccggtgacgaaatacggatatcagtgtgtggatgcgcggattgacgccggggatacggcagacgatgccgatggaaatctggtcagcgccctcaccggtgcatttgacgggagcttccagtaccagggcgtgatgccgaaccagccggtcaccattacctatatttatgagccgacagaggaaggctatcccctgaccgtggaatatgtggacaaccagacacaggatgacagactgaaaaatatcagggaaccgctgcgccacatgcatcaggcggaagaaccggtaggacttgcctgtgcacagggcggaatggaataccaacagccttacggctacagcctggcggccaaggccatcagcccggtgaccaataagatcagctggagcggaaatgattttacgggaaccatgccgaatgacagtgtgaccgtgaaatacagccatagccgtaccgcatccctttgggcggacattacctaccgcgcaggagccggcggaacgctatccgcggcggacgggatgtctccggatgtacaggctgttggaaacggcagcttccggaccagcgctctgattgatgacggaagtgaacagggagcggaaaatggctataccctgaaaacattgacagacaaaaaactgatgccgaaaggcgatgcgaacaattattaccgttttgacggatggtttgtggatgcaaacagcaatggaatgctcgacggcggtgagacactgcttggagaggactaccacattaccggtgatacggtattgacggcgtatttcggagaagatccggataaatgggtggatatccgttttgaggcgggcgcccacggcaccatcaatgcgggagaaccggtgggccttcataccacctttgacaagaagtggggagacatcacaggcagcctgccgcagtacaccccggaggtaaattacctgaccgtgggctggtatgcgggatcaacgcctgtaaatggggaactcggtctcgtaaacgggcagacgtataccatccgtttccgtccggaccccgatgtatttggaacggaagtggcccagccggaagtgctggccggtttaaacagccagggaaaaggccgcgtcaccgtgttccacacaacgcagggatatcagtatattctgacagacactgacggtaagattcttaaggtgcttcgcggaaatgagctgtccgggcgcgtggcgtttgatgatctgtatccgggcgcgtattaccggatctatgaggccgatgagtatacccaggtccagaccggcggtcagatcgacgagattacggagcagttaagcgcgccggcagaggcgctgacgcctgtactggagacgaattaccagattacttatgatgagaaagaggaaggcaaaacctgcctggtgatcaaacccgcggatcctgattcggaatacgcggtgctcgacagcaatggccatgtggtggaagtgccatccgccggcgcaggcggctggaagaaaccggccggaagcccggcttccctggaatttgcgggactggattataaccaggagtacacggtggtggcccgccctgtgggacagacggacattacggcggagagccggagagaggcaggaagcgtcataacaaccgatccgggtgtagaactggaactgcctgaatatatcgttgaggcggtaaacggacagatcctgcaggtggcggatgaaaccgtcggcgaagagcggtacgagaaagcccataagggtgaccgggtcagaattacggccgatgcggcagacagtgcggggaatccattttcccactgggagacgaccatcggaaccgccggaaatctgggcgataagacaaccgcccgggaaaccagctttacgatgcctggcgccaatgtggtgctgaccgcggtctataaaaagccggtcgcctcaccgagcaacgctgcggtcgtggatgaggtgagaggcgggagccggaaggaaacagcgctggatcccaacgagattccaaggctggaggaagagctgacgacgaacgcggaccgggagctgatcgatgtaaaccgcgccgatgtgacgtataaaatcgtatacagaaagaacgcggtcaaagcgtcggaatccaatgcggtaaaagcctccggctactacgaccagaaccatgaggaggcctataagggcgcctggggactggatgtgctggcggaacggtatgtcaatggaagaaaggtggccggcaccccggaacctgaggcttccttccggacttacatacagatgggaaaagacgatatcgacatgatggattaccagctgtatgaaataacagaaaacccgtcaaccggtgagacggaagcgagtctggttgatttggactatgacccggagaccacgggagggctattcaccttcacggcccatattggcagccggtatgtgatggtatataaccgggcgtaccgcgtgttcttcataaacagcgtggtcctgccgattgaaaaccggtaccgctattcctttaaggtccgccgcgaggaggcgccggatgacatttattacagcgacgcgtacggacaggtggcggatcaggtggaatactttgtgagccccaccggagcggaatacagctatgaaggatggagctatgaccagaaccggtttaaggagtttgacccctccggagcgatccgaagaaagacgtacgtgtacgcctattataaggataatgtaaaagaagtggacgatatcagaaagaagctggaggaggcgatcgaggaggccatacggatcagcgatgaccacttcctgaagctggaagagagcggaaagctgaaagacgcagtggaggaagcactggagatcctggaccgtgagaatccaagggcaacggccggtcagctggaagcggctctggaaaaactgaaggagaaaaccgagccgtatgaaaagatcctggatgaccgttacaaccattacgacgagattcaggaaggcggaaacaagggcggcaacaaaggcggcggtggtggcggacacggaacaaaacagaatccttttaacacaaatacgccgaaaagctacgtagttggaaccaacggaaactgggtggaagtcagcgcgcccgagggagaagagaggcagatggccttcgttctgaccggaggaatgcggttaagcggaatgtgggcgtggatcaagtatcccgcggacggaagcggcaatccatcagacaggaccggatggtactattttagtgacaagggaatcatgcagaccggatggatccgggataaggccggaaactggtattactgcaacacggaaaaagaagggagattcggcagaatgcagaccggatggcaccacgacactgcagatggaaactggtattacctgattccggaaggcggaatgatggctgtgggctggcgaaagatcggagacaaatggtactatttcgaaacggccggagcgggagtatacacgtacaacccgactaaggaaaactggaatttcggcggaggaaaaggaaggccgctgggttccatgtataaaaacgaaaaaacaccggatggctttgcaacggacgctgacggtgcgtggattcagtaggaggaactcgatgaaaaaaagatttaacttgaaagcaaagctggcggagcttctggcggcagtcatggtattttccatggctgccccgggtattccggcgtatgcggtcaactatggggagacgtctgtcattgaattcgatccccaggcgggcccgggcctgctccattccagctacagcggcgtgcccaggcgggcagacggggtctcctttgccacgggacaggcagggcatccgctgacggactcggccgattttaacggaattcccagagaagattttgggtccgggcagaggccgcaaatcccggaatttaatgtctcgtgggacggctacacgtttgatggctggtataacgaggcgggaaacaagattctgtccctgccgtacgcatttccctattcgcaggtgagcatctacaaggccgtgtggaaaggaaatgcgacgagtccgtttcaatttacggtgatgcactaccgggatttaaataccggcagagacaacaacaataacggcgccgatgagaatgcatggccggcgtccggagccgcggatctctggaagttttatgagtcgccggactggacgcggtcggttatggccaataccccgatctctgccacctacaggagagatattccgggataccgcttaaagtccgtgctgataaaaaataaccgggtgcggaagtatgaggaagccagcggccagggaagcctggatggcggggcctccatcaactcggcgacaaacgcggtgcgcggcaatatgcccaatgacaatctgacggtggcgtaccggtatgaacccgatccgacgaagaaatttgcggtgaacgtcgagtatgtggattcctcaggaacgcccatcaagactccggacacctttacctttccggcggaggcggagatcgatatcgcacccgcgcagatcaacgcatatacgctgcagagcagcgagataaaaccgggctttgaggggacggatgacttagcaggccagggaatctattcggcggcgacggcgggctgccattttgacggaaataaccattttaagggaaagatggcgaatcagcccataacgattacttataagtatgcaattgatcccaatttccatacgaggcttcaggtaaagaggctggataaccacggaaatccgctggaggacgatgagatacgggatatcactccggcgactccggtcgtgatcgatgtggaacagaagacgggctacaattatccgcccaacattcgatgggatgagcattttaccggaaatcagaacagtttcgatcccaatgcgaaaacccttaccctaaacagcgacatgcagggcgggatcgtgacgattacatataatgaaaacctgtcggacgaatcgtactgggcgaagcttgagtattataacggcagcaacggatccatctccggggcgacggctccccgttttaagaagcacgggaattataccatcgaagaattgacggatggcatcgcggcttctccggagtctcattaccagtttgacggctggtacaaggccaatggaaatggaagtgataagacgggagagcggctggagggaagtctctccataacccaggcgacgaagctgtttgcaaattttgaggaagatcccaatgagtggtttgacttaagctttgaagccggaaatcacggatcgcttaccggagtgacctcgattcacacagaaaaaggcgcgctgtggacctctttgaatcttccgactgccgtaccggatacgtattatacgtttgcgggatggtttgatgagagcggaaaccgggtgcaggacagccagacggtattggctgaccagcattatacggcaaggtttgttccggtcagcatgccggacgacggaatccttgcaatgccggatgcgagaggcactgtggctcaggatgggcggggaaaggtctccgtatccggagctaatgaagggcgcagatatgcactgacggatgagaatcaccgcgtgctggcggttaagaccggcgttcagctgcaaagcggcgattttatcggattgtatccgtgtacagcctactacgcgtatgagctggccatgggagcgaatccgaccgtcggaacgatcctgccggacagcgtggatcccctcgacttcggacctcctacccgggtgactgtaccggccctgggcggcaattatcaggtgggagcagattcctcagaaggtaagatgcggattaccatcgacccggccgcgccgaataccctatacggcattctggatgcggaaggaaacgtgatccaggtgccgggagctgatgaagacggctggactgcaggcgccggttccgcgggagccgtctccttaggaggcctggagccggatcagctgtacacggtcactgctaaacacgccggagaaacggcttcggccgccgacaaacggattatgggaacacaggtagccgttctgggcagtgatcagcaggagcagacgtatacggtatccctgacaaacggcggatacatcgatgagatagtaagaaacggcacagcactggaaatagaatcacacgctgtgaacgctgtcgtaagaaagggagacattgtaaagattaacgcagataccacggatggaaacggacaggcgtttaagcagtggaataccctgattggagccccgcagctctttgcggcgagaagaaatcagccggtgaccatgccgggacagaatgtcgtgctgcaggccgtttaccagtcgccgccaacggccacaccgggcaatgcatcggtggagttttcgccgaaggatggtaagacagctctggatttatccgggaactatcaggagagcctgatacaggcgctgactgccaacaccagcgatcagacagccatgacacagggaatcgatgtggaatacacggtgaaatttaacagaaggccgccgaaggcttcggaatccaacgcagtgaagcaggagatgggagaggacggcgatctcgtgaaagtgccgtggacgctgacctcttccctgacaagaaaggtgggcggaaccaataaggagctgccggaagacggaaactcccagccggatatccgggtgtatggtgtgatcgacaacaacctgctgggatatttggactacaggctctggaagatcgatgatccggagggggcgccaagctgtacgcagataccgatagaaccggatcccaacagcaccggtgaggcattccggggcaccatatccttcgatgccgcggttgggtctacctacgtgctgacgtatttgaaggcgcatgagataacaattatagacggcaagagagcggccgttcaccgggtgaaggtgaagtcaggcaccgcgctggaagacacagaggaatttaacgacctggctatttttgaagactatacagacccggttaccggaattgtatacgagtatcagggactgggagtatccgagtcttcggcagagtacgatgtgtcggaaccggtcacgcggtcattgactctccatgtccggtaccaggccgcggatgatgcagagtggcaggcggccaggcggaagctgatggatcagatcgctgtcgcacaggcactgatgaacaatacgtcggtcagtgaagaaaacagacagatcttaagcgccgcggtggatacggcgctggaagtggtaaacagagtttaccggccaacgctggaagagcttttacagacctatgaggaattaaagggaatcgtggacaccatcagttcgggcggcgataatcccgacaacccggataatcccgataacccggataatcccgacaacccggacaatcccgacaacccggacaatcccgataacccggacaatccggacaacccggataacccgggtggaaatggctccggcggtggttccggttccggcagatcgggcagagtcctggggcccggccagtcctttaaccgttacagaacgtattttaacggaacagatggctcctgggtgcagggcggaaacgaagaacagagcggaactggaagcaaccgatggatgttcgtcctgaaaagcggcgcgagagtcaaagacagctgggtgaatgtgaggtatgaaaactcgcagcagctttacacctaccacttcgactcggagggctgcatggacacgggctggtatcaggattctgaggggcagtggtattatctggtccctgatcccggaagcgagcagggacgtctgaagatcggctggtattttgatcaggaagccggaaaatggtactatttgaaccagtttaccggaggaatgcttacagactggcaggagctgggggacggctggtatttccttaacccggtgagtcagccggggcgtccatacggatcgctgtatgtgggcgaaatcactccggatgggtatccggtagatgaaaacggcagatggatcagagaaacgccgtaatggcccgctgacggcagaaatgattgtgggaacaccggagagcggaaaacagcagaacgtgttcccacttttattcccgcggacaacgagtcgggcgggcgcgcctgcgggtccgtctgacgactgccgcgagggtcaaaaaccggtggagagaggatagatgtatggtagaaaaacaggaactggaggcacggtttaaggagctgaccggcacggaccgggcggggatcatgctggttctgattcacggacagaaggaggagaagctcttcgggcagattattaaccgatatttgagaaagccggtcttattttacggaatggatcagctgatcctgaaaacagacgaaatttgtgaacagattggtacccccatgctttccatggccccccgttttttgcaggaagaggaaaaggaacggtatcaggaactgtcccggacgaaaaatgaactggagaaaatggccggagactggcacagaatgtctgatctgttacaggcccaggcgccggcggccagggaaattcttgagattcaggttctgttccgaggcaatgccacgatgcagggaaggttccggtgtccgattaccggcagaaattacatcagttttcgcagtgccctggagcttcagcggatgcttagagaggtggaaatccagttttgtaccaataaccggtcagacggcaaagtgcctggcctggccggcccagggaagattttaaacagaaaaaaaggaagggtcctatgatctgcagtgaatgcaaacgaaagaaaagacagaaggacatggtctgcgaaatatgcgccgcattggataaaatgcgggaattcgaacagtttcaggaagagatgaacaggaagattttttcagaaaggaacgaagtgggggcggtaaggtgaatgaatatgaaatgattatagaagggatgcattttggggtcagcaagcatctttttgacaagcattttaccatcctgtgggcgaatgattacgcatacggtctgaccggttatacaaaagatgagttttatgtaaagtatcgtaaccgggttgatgagtattacaggaaggacagcgagacgtttgactacatgtccagtgagatagaggaagcgtggaaaaaacaaaaggaaggctacttattcgagtgtccggtaaaaccgaaaagagggaagacggtatggcttgccatgaacggccggttttccggggagacctaccggggagtcccattgatctggaatgtgttctacgatataacggacatacgaaggagccggaaggagctggaagagaaatcggagctgttaatcagagagcttcagagggtggaacagatgaaacagtggctcacctgctttgtatcagagttaaacgaggatgtccactccatggccaatatcattggcgggctgtccgacgtggcggtcctctctctgaacgatccgaagcggtgtgaagcgtgtttgaaagaaataacggtgaccagcagacagctgaggaaaaaagtctgcggcgccagccggaattttcagcaggaggctggtttagaatatgaagtataatcgtgtggaggcggccaggcggatcagaaaaaggcggaaagagcttgggctgacgagtgcagaggtcgcggataaaataggaagggcgaaccactattacggtgatatagagcgcggcacctgtggaatgtccattgataccctgattgagctgacggaaatcctggagatttcctctgattacatcctctttggaaagaggaccggaaatgaaatatcgaacgccgccagggcctgccgcatcctgaggcagtgggatgaaggaaaacaggagcgtgcggtggatttgatgaagtattacctggagctggataaatgatggcagcggctgcggtacctcatgtatcgtacctcagccggttgggaaaggaattcctgtattccgacggcgtcagcccggtttcacgcttatagattttcatgaagttatggctgtcgtggtatcccagcttctgggcgatctccttaatggaaagggaggtctcagataagtaatagttggcctgtgagattctctggttcaggataaactggtgcagggacacgctgccgaggctcttaaacagccgggcgatatactgctcgttgtagttgaacttattggcaatgtttctcagctttagatccttgtccaggttttcgtcgataaagtcgataatactgttatagatacctgtgttggtctggaactgcgcttcctcatcactcttcagaatggagatctggttgctgatttcgcacaggatgagcgtcgttaagtagttgacctccaggaaactgtagttggaacggatggtatcctggagctgcctcataaaaattgctattttctcagggtaaatcagggttccctggttgggaataaaaatctcattgacggcctccagaaacggaaagtccacgttttcgaactcggtcttgcggatttcggaggggggataaaaatgcagccagtaaaagtcgcacttattgttattgtaaccgcggcgtacattgttaggggcctcgtgcgggtcgatcagcagaaactgattttcgtggatggaataggaaatacccctgtattttaaatacagaattcccttcgtgaccacgcataattcatacgaatcatcgagcggaagggcatcatgcctccagtctgaggagggagcctcaaacttgccggtatctctgcaggataaaggctgggaaatattgatgatatagccattttcttgagttttcattactgcctccttattttctgagtacatactatgaattatataataatcgtgataaagtgggaatggcatttagagacaaaaagtgtaaaaaacgtacctatatacaggtaatgtacgttttttacactttttatatttttataacatttacacaaaaaatacaagttaatataattgaatatatcaaataaacacagtaaaggagaagaaggtatgagaaaaaaatggtttggtttgatgacagcaggtgtattattagtatcttgcttgatgacaggctgtggaagcaagacatctgaaccgcctgcgtctgccgcagcagatacgacggcggaggcgaaggcggaggcggaaccggaaccgtcaggcggtgaaaaggtgaagctggtcggcatgacctgggggagcacggcaactattgaaaattatacgaaagaattcttcgggcagaacccggaaatggcagcgaagtatgaggtggaatgggttgtgggaggaaagggagacgacgatgtgacggagcggatcaggctggccctgtcatcgggcgagtatgtggccgactttgttcagttaaattatacgcaggttcccgaatttgcgcgggagggcgttctgaccgacgtaaacgatgttctcaagaagtacgaagcggacattgcggatggcggattacagctgatgcggtatgaagattctacggttgcctttccattcgaattaaaaccgagagtatggttctaccgcagtgatatctttgaagaagcgggaattaacgcggatgagatcaagacaacggacgactttattgcagccggcaggaagcttcaggataaatttcctggaaaatacatctgcaatgtcggttcctccgctcccggctacttattctacatggctttaagcggaaatggtgcaaggtttacggatgacaatggaaactataacatttcacaggatgaggggacaaaaaaggtactggaagactataagaaaatcgtagaatccggtgtctccatggatgtctctgacttcacgacggactgggaagcggcactcgcagacggaagtctggtaagctccttaagcgcctcctggctggctcaggattctctgcttccaacttatgcggctggacaggaagggaagtgggcctgcgcccagtggccggagatcggcggctccaccggaggcagcgatgcaggcggatcggtattcgtcattccatcgttctctgagcataaggaggaggcaaaagaactgctggcggagatgaccctcagcgaggtgggtgacctctgtatctgggacagcatcagttccataccggtcaataaaaaggcactcgacaacgagagaatgcaggtgccgaacaagttctttggcaccagtgtagtggaagcgggtaagactgcggtttcaaagatgagcgtatttaactattccccgaaggctcttgcggaaacggatattgtgatgccttacttcgtaaaggcggtaaacggagaactctcgatcgacgaggcattagccgcggcagaaaaggatttaaagagccagcttggcaatgcatttgaataaccgcggtattgacttatagacaggagaaggaatgaagaaaaaaacgataatcccttacttatttataacaccgtttctcattgcgtttgttctgttttttgtatatccggcgggatactctctctatttaagctttcttaagtataaggggtatggagaagcgacctttgtcggacttaataactacaagtccctcctgacctatgcattgttctggaaatccctggggaatacggcgttctatttcctggcacactttgttcctgttatggctggtgcatttttattcgcactggccatgcagtcgagttatatcggcagggcgcagaaggtcataaagcctgtgttatttctgccgcaggtggttccgcttgtggcatcggctcttatttttaagatcatcttttccactaattcaggggcgctgaatcagataaccgggctccatgtgaagtggctggaggatccgggcctgcttaaatggccggttgtatttctgattatctggaggtcggtgggctggtttatggtgatttttctcgcagggctgacgacgatcagcagcgatttaaatgaagccgcaaccctggatggagcgaataactggcagcggatcacgaagatcacgattccgctcatgaagccgattttcctgtttgcatttgtgaccgatgtcatcagttcgttcaagatttacacagaacccaatgtcatgatggtggagacgggaacgatccccgtggatgcacagccggtgatgaatatcatcaccaataatattaaaggcggaaatttcggaatggcttcggcggcaggctggattctgtttctgattattctgatcgtttctctggcacagctgtttttgatgaagaatagggaggattgatgatgagcagagctataaaaaaggttactctttctgcccttctcacatttttcgctgccgcagcggtggtgccgattctgctcatgctcgttaattcctttaagacggggagtgagctggcgaaaaacgcatggggaattccgtcattctggacgttttccaattatgcgagcctggtcagcttcaattcaggaatcctggtccggacgtttttaaacagcgtgtttgtttccgttgtctatacgctgctgacgctgattgtctccagtctggctgcatttgcattttccaaatacagcttcaaagggaaaaatgtgatattcatattcctgctggcgacaatgatgattccggtggagatcacgattccggcgatctatctgatgttcagcaaggtacacatgctcaatacgtattccgttcagatttttccgggaattgccaatgtattctgtctgtttatgctgaagcagtatatggacagccttccgaattcccttttagaggcggcaaggctggacggagcgggagacataagcatctatcagaaggtagttctgcctctggtgtcaccggccatcggcgccctggcgattctgacatttctggggaaatggaatgactacttatggccctccatgctcctgaccagggcagaggtcatgccgatcatggtggtgctgccaaccttaaataccgggaattcccagtggtccacaccgtgggagctggttatggcgggatgtgtgatcgtcacactgccgttaattattgtattctttatttttcaggatcagtttatgagcagcgtcacaattggcgctgtaaaagaatagaaaggactgaatcatttatgttgcagcatggaacgaagggaaattggaagaagtatgaaaataatccggtgcttggaggaaaatacgggacgtgtttcgatattgcggtactggatgaaggggcggaaatcgccatgtatttttcctggcgccccaggaaaagcgttgccgttgtaaagagcagagacggcatacactggtcggagccggaaatctgcatcgggccgagagactcggaggaaggctgggaggatgaactgaaccgcccctccgtcgtgaagaacggcgatacgtatcatatgtggtataccggccagtataaagcaggtgaggcggatggaacctcccatatcttctgtgcagtcagtacggatgggattcattttgaacgggtaagcgatcagccggttctgctgccggaggaaccgtgggagaaagcggccgttatgtgtccaagcgtattgtgggatgaggagacaggacggtataaaatgtggtactcggcgggcgaacagtatgaaccgaatgcgatcgggtatgccgagagtccggatggacttgtctggcagaaatttaccggcaatcccattttctgtgccgatccggacacggagtgggagcagcataaggctgcgggctgtcaggtactaaaaaaagatgaacactattacatgttttatattgggtattataacgaggattatgcacagattggaatggcccgttcgagagacggcaggacaggctgggagcgatcttccttaaatccgatcattgcgcctggggaagagggatttgactgctgtgcatgttataaaccgtttaccgtgtttaaagatggaaaatggctgctctggtacaatggcagaaatggcgctttagagcagatcgggctggtgacgcatgacgggtatgattttgccttttaggaacgtgaataaaatcgaaaggaattactgggaaagatgattttggataaggtgctggagaagtatgtagacagatttaacgcggaggacgaggagatataccgccaggagattgggaatgatcaggcgcttgactggatgagggagaatgtacctctgttcgaatgcccggatcctgatatagaggaaatatactatttcagatggtggatgtaccggaaacatgtaaaaaagactccggagggattcataatctccgaatttctgccggaggtaccgtgggcggggaaatacaactcgattaactgcgcagccggattccatatccgggagggaagatggctgaggaacggacggaaaatcatagaggattacattcgtttctggctgagagggagcggagatgtccggtcttacagcacgtggattgccgatgcagtatgggactactgcagtgtacaggaagactgtggatttgggattgaaatgctggatgatctgatctcgaattttgagtggtggacaaaagagcatcggagggataacggcttatactggtcgatcgatgaccgggatgccatggaattttccatcagcggatccggattccggccgacattaaactcctatctttacgcggatgctgccgccatatcccggctggcggaaaaagcggggaaagaggagacggcctcccggtttgcaaagacggcagagaagctgaaggaaagtgtgcagaacaatctctggaacggcgatttctttcaggtgattccggcaaagatcgattgtaaggagaaatgtttcatcgcgtgcggcacgatggattttgaagaaataccggcagacagaaatgtgaaggagctgatcggatacattccctggtattttaatctgccggacgcgggatatgaaaaggcgttttattacctgacgcgggaggagaatttcttgggaaaggctggccttcgcacggcggaccgatcccatccccggtatgcttatgaggtgccccatgaatgcctgtggaatggtccggcctggccgtttgcgacgacgcaggcgctggtggctctggcgaatcttctgcagaactacagccaggagtatgtgtcaaaaaaggattactaccggattcttaagagctattcagagagtcagcaccgcatgacggaggagggaaagacgattccgtggatcgatgaggatcaggatccggagaccggcgagtggatagccagatctattttaaaagacgggggctggaagccggaaaagggcggatacgagaggggaaaggactataaccattccatgtactgcgacctgattatcactggcctgctggggatcgatcccagccaggagccgccggcagtgaagccgctgatcccagaggactgggagtatttcctgctggaaggggtaaagattcatggaaaaatgtatacaatcctgtatgacagggacggaagccgttataacaggggggaaggtctgcaggttttattagaggaatcgatacagatataaaagaaaagtggtcattaaatccctggtgagagatttaatgaccacttttggttattccattctctgcggcgcaacctgcgcccgctcatgatcctgcaaaaaccgctgttcaaattcccccacaggcatgggcttatagaagataaatccctgtatataatcgcatccgagcccctttaagaagtcgacgtattctcttgtttcgattccttcggcgacgatctttaaatccagttccttggctgtctcgacgatgtggcggaccagaacacgttctctgggatcggagtaattccggaacagtgagcggtcaatcttcagggtcttcagttccgtgcttgtcagcacgctgaacgaggagtagccgcttccgaaatcgtccagggaacaggaaaaaccgtaatcccgcagctgttccacgacatcctgcaccagatccagctggtttaagacgatgctttccagaagctcgaattcgatacagtccttagggcagggaactttttcataaacacgtttgtactcgtcaagaaaatagcggtagttgaacatgttgctggagaggttgacgctgatcctgatcttccttccataaattaaaagccagcggttaatggtgctgcatacatgctgaaacatgtataagtccagatcgccgatcaatccgttcttttccagctccggcagaaattcgctgaccgggatcatgcctttttcaggatcgatccagcgtaccagggcctcggcctccgtgatttcccctgtgcgcagatctactttaggctggagataaagcttaaagtcctcccgttcgatcgccggccggaaatcctgctccatattgtagtttctcagatttgcatcccggtatgtaagtccgtatacttcaaaatgagaattgcgcagaccggattcggcgctttctgtgcggcagatatcggcattgtactgtgcggtaagaaagtccggaggattgtgctccagccggaaaataccgaagcccatgtatatttttccatatttctcgtcataaggccagtcgcggatcctgctgttaatttcaatgatataatggaatatatcgtcatagtcctccggcatatgaaccaggaggagatagtagccggaacggatatgcgcaatgtattcctccggcttcagccaggattcaacacagtcgtagatcatggtaatcaactcatccccggcttcccatccaaacatccggttgaatattcgaaagcgtttgatcttcatgctgatcagggcgtattcctccggattattcctgcagacttcttcataacgtgttcttatccactgctcattttttaaaccagccatcgcgttatcctctgttttccattccttttatttaattagtatcggttctgtttttagtaatagttccattaaaagccgcgattgcggattctgttttatagttgacagacttcttaaaatatataaaaaagttacgtaatcaacttatctgattataactatatcacaattgtaactgtcgggcaatgttgtgcgcttaaatttaacaaaaacatttcaaactgtacagtaattgtgaaaaaatatccttaaaaatatgaaatattaaactcccgctgttgctgtgcagcgggagctcatcttcagctgttcaaacttcgctaaaatctgatgtatgttagaaataaatgaaaaagttggtaaaagataccaattattgcgttgctgttgtataataattttgtcgtttgagattactttttgtaattagacgtaaacttatgataataaagggctcttatacggcaaatttttctttttatactgttttataaattggaacaaaaaatagacatatccgagataggaggtcaatcatgctggagaacataaagttatataatgagctattaaaaagaaacagtaattacaggataaatgttgagaaaatatatgagtatgcagttaatgtgctgcctaaaattaacagagtttttgcaaattatacggggcatggaattgaacattcccttaatgtaatgcagtatatgtatgagcttgtgacagatataacagcaatcagtgatttagaaattacgtgtatgatctcttccgcattgcttcatgatataggcatggcagtcaatgatgaggagatagaatacgtaaaaaatgatgaattagtctgtcatggaagaaagtattccgtcatttacaagaagtttcaaaatgaaaatacggcattacaggaatgcataaggcctgtacatggagagcgggctctgacccatattctgtctatggataagagtttatttcttataccggaatataccaacgggaattttcaagaagaactggcaaaaatatgtcaggctcatacgatggatagaaagtggattgttgaaaatttggataataaccaggtaaaagggaaggatcgattaaatgcacagtatatagccatgctgttacgtattggcgattatctggatattgatgaaaaaagggcgccaatggagctgtatcgattgatatctcctactgaatttggcgataaagaatggaaacaacattatattatagaaaacagggaaaagattattcgggacagcgccactcatgtgggtagagtagtaatttacggacagtgtgacaattataaaatacacagaaaatttttgaattatttagctggtttgtcggatgaacttttgtggtgcacaagttattcagggaaccactttgaggaaagataccggttatttgtacaaccgcaaattgataatagaatacagactaagggatttgaaatctctgacttaaaactgcagttggattattatgcagtaatgaagttgttgatgggcgagagtatatacgggaataaaaaatttggcttacgtgaattaattcagaattcggtagatgcatgcaaagtaatgatggaagaagcagacaagctggaaaagtaccaatataatccgtatattccgaaagttcagattataatagattataacaaacagaaaatgattgttctggataatggaacaggaatgaactatgagatcctgacaaaatattttcttaatatcggaaaatcctattatcagtcagatgaatttctttatcaaagcaaagactatcatcctattggcacatttggtataggctttttagcgtgctttatgctgtcgaaccatgtgtcagtagaaacgaaacactatttagagaaagaaggatttacaattgaattggaatccgacagtgagtttgtctgtaagaaaaataaggtggatctgatcagggattcagggaccgcagttattcttaatttagaaagtgttttccaggtatttgatgaaaacgcagagaatataaaaacatttgtagataggacatttttagatcagggagtacaggtgcagtttattatcgttgatgcagcaagaaaaacagaagaattaaatctgaagaaatatgaagagcgaaatcagggggcaatcgtactggattcttatttaaacggtatatcagcatcacttgaactacagtctgatactattaagattagcagaaagctttcagaattatgtgtagaatcaatgaatgaaagacaggaattctatgagtacaattcagccgaacatcgcatttgcagcagagatctggaaggaaaagatctgggaaattatatcaacggtaatcaaatgatggtgattaagatagagggagtaagagaggaagaaaaagcagaatatgaagaatggaggaaatggaatacagaattaatctttacgcccaaagaaatgcaaaaaaccatatactttcctgtaaaatatgatgaggcattattaaaatactgtaaagatggttctcatttctggaatggaagcggagcacaatggtacactgttatttcaaggtttcataagataaagccgagtcatgaaaataagcgcctggaaagcattttaaaagaatgtaaaatactaactacagccttatatgatgtagaactgggaatatttccgttaataaaggcaggtaaagaacgctacgcagaatttacagatgctgtttatttagggaacggcgaaaaagaaaacgaaacctattggcatggaatacggctggaaaatggtggttttgaaatagacgcggagattatcggagttattatcggagattgtgtagtaaatattacacgtaatgatttaattccaaatgttgccagaaatgatttaccggctgatgaaaaacggaaggtagaggaagcaattaagagggcaatgtatcagtatatgatggataagatgaccgatctggaattaaaaagtgcgatacagctgtttgttgatgaaaggtatcctttaaataatccttattatctgaaaaaatagaccgtgcgcctttgacgtttgggggactgccagatatgcagacaagcgtcagaacacagaataaaggatcatcataacacttgcaacattcctctgaattgcttataatgtgtagaaatagacaggaggaaatagcgcgatgatagaagacataatactgcacaaccggaaattcgtggctgaaagaggctatgagccatacgagaccagcaaatatccggacaagaagctggcaatactgacctgtatggatacgagactgacggagctgcttccggctgcactgggaattcgcaatggagacgccaagattataaaaaacgctggcggtgtaatcagccatccctacggcagcgcggtgcgaagtcttctggtgtcgatcctggaactgggcgtggaggagatcatggtaatcggccacacagactgcggcgtccaggggatggacggtgaaaagatggtggcgaagctggagtcacggggaattccgaaggagcatatcgatatcatccgaaagagcggaatttctctggaacaatggctgggcggttttgagtcagcggaggaagccgtgaaagagtcggtagaaagcttgaaaaaccatccgctgatgccgaaggatattgtgattcggggatttatgatggattcggtgacgggtgagctgagtgcgctttcgtagtttaatccagtacagcattgcgcagcacagtacggactgccagacagggaatgagaaggaaaacgtccttttcgttccctgatatttttagagttaagttttgcttatgtgcgtatctatccgggaaaggatgttacaataacattaaaaaagaatttggagtgggaaacggtatttttatccgaaacatcctgcaaacaaagtataacaagacgcaaacgaaataagacaagataaggaatatgaaagatgcaaaaaagagtattaataggattgacaggtgccctgattctgctacttaccgcctgcagtgcgaaaggcggcggtacgttgatggatgcagagagtaaccgcagtcaatggccggtacaggaagaagggactatggattcttctatgccaggagaagacggcagcgcctccctgtcagcagaggccaatacctccctgtcagcagaggctagcacctcccctccaacaagagaagccagcatcaatcccgcttcatcagaaccatccccagacagcgccgaccccacgctccaaagcattctgtcccaaatgactctgcacgaaaaggtatgccagatgctggtcgtaactccggagagcatcactggtgtggaagcggtgactgcggcgggcggcaccacaaaaaaggcactgcaggcaatgccggtgggcggaattctgtacagcaagcccaatttaaggagcaaagaacaggtgaagacgatgcttcagaatacgcagagctactcggccatccctctgatgttcacatgcgacgaagagggcgggagagttaatcgtctgatgagtacggtaaatacgacgatgatcggcccgatgctggattataaggatcagggggcggaaaccgcgtataaaaatgcctgtacgattgcctccgacatgagcgcactgggctttaacgccgacatggcgccggtggcggatgtgtggtcgaatccggagaacacggtgatcggggaccgggcctacagcgacgatttccagcaggcggccgttctggtcgcatctgcggtggagggctttcatgcgggcggagtggcgacggcgctgaaacattttccaggacacggcgatacctcggaagactcccattacggagccgtgttcataacaaagacgctggaagagatccgggaaaaggagctgcttccattccgggcgggaatccaggcggacagtgacatggtcatgatcggccatctcatattatcagatatcgacgatcagccggcgccattttcccataagatcgtaacggaattgctgcggcaggagcttggctttgacggtgtgatcatcacggacgggcttcagatgaaggctatgacggatttctattcggacggagcgatcgcgtgcagtgcggtcaaggcaggcgttgacatgctgctctgcccggcaaatccagaggaagcggcggccgcgctggaagacgcagtgaaaaacggggatctgacggagagcagaatcgaggaaagcgtcctgcgcatcctgaagatgaagaaagagagaggaatgattccgtaaatgcggcaacaggacaaattttctgtagagtaaaaatgtatgtcgtattctcagtagtacttgtaatcaataagcggtatactgttatccatacgaatgacagaacaggagagaaagagtcctatgaaggccgcaaagaaagtagatatgacacagggatccatcatgaagcgggtgctgctgtttgcccttcccatctgcgtgggaaatgtgctgcagcagctctatggtaccgtcgatacgctggtgatcggcaatttctgcggttccgtatcgctggccgccgtgggcaccagcagccagccggtggagatcctgctgtgcgtgttcctggggcttggcaccggggtatcgattctcgtttcgcagtttaccgggagcggtgacatggaaagcctgaaggagatcggtgcaaccgccatttcctttttgtttctgtgctccatcccattgacgataatcggacagtttgccggtccggcggttttgcggttcatgcaggtgcccgatgatacgtgggagctcgccaacgcctatatcagcattattttcttcggaactctcgggaatatgggatataacatgaacgcgggaatcctgcgggggatgggagacagcaacgcgtctctgctgtttttaatcgtctcctgtgccgtgaatattgtgctggacctggtgtttgtggccgggctgggcatggacgtggccggcgccgcgtgggcgaccaccatagccatgtactgctcctggctgttcagcatcgtctatatccgtaaaaagtatccggagttttgcttcacctatctgccgcaccggatgaacaaacggatgctggggagtattgtggcgatcgggcttcctttgggattaaacagctccatctattccgtgggccatattctgatgcagtcactgatcaacctccagggctccatattcattgccgcctgttccgtgagcagcaaggtcacggggattgccaacgtggcgattacctccctgtcttcagccgctacgacattttccggtcagaatctgggggcggagaattacgtgtatttaaagaaaggcggaatccagatcccgctgttctccggtctgatcacctgtatcgccggactgctcgtgacgttctggtgccggccgcttctggagttcttcaccagagacgcggcggtgctcgacatcgcggtccggtatatacggattgtcctgccatttacatgggcctatgcggtatttaacgggattatctgtttcgtaaacgggatgggagaggtccggttcccgactgtcgtcaacctcctgatgctgtgggccgtgcggattccgtgcgcctggctgattacctggtacatagacggcggctatgttatggcctgccttcccatcagctttgtgttcggaatgtgctgcatgttcagctatttcttttcgaagaactggaagaagatcggaaagctggcggcagagcagcagggtggatgaaataaaaccgaatgaaaaagagaagaggaatcagactgccgatacggtctggttcctcttctcttttttatgaacggctgctgtcattctgtttcctgttttcctaaatattcctgttcaaattcttccacaggaaccggcttgctgaataagtagccctggaacagatcgattccgcaggcgcgcaggactgcaaactgttcctcactctcgattccttccgccaccatgcggattcccagcttgagacagacctcggagatggattccacgatcgcccggttccgggaattcgtggtgatgtgatcgaccatgctcttatccaggtttaacgcgtcgaagctcacctcggacatgagaacgacattggcacattccgtgccgaaatcatcgagagtaaccgtaaaacctgcgttctgcagctcggtgattaactgtttgatgttgaggttttcctcgttatgaactttttccgtgatttcaatctccagatagcccgcaggaatcccgaactggttacagatggccaggagccgttcggaaagcgccgcctcccgcagggtgcggagcgaaaagttgacggatacggggaaaatctgtctgccctgatcctgccacgccttaagtctggagcacacgaatcggaaaacgtagaaatcgatcaggctgaccgtatcgaattcctccagcagaggaagaaattcaccgggagtaatcaggacgccgggctgcggtgtgtagcggataagcgcctcacagcctacaatcaggcggttttccgacgaaatcttaggctgaaaataaacaagaaaatgattttccgcgagttccctttttaaggtttcggaatcggataaatgctgcagcagcttatcgttgcagcggcgatatctgcgggatacaggattgatccggtaaaatgcctttttattttcatacattttcgcgtcggccgccgcgatgatccggccgatgttctcgatgctttccatccattgggagccgatggcggcctggcagtcggagtcgttccggaacttggctttcagctcgcgcacctgattcaggaaaacctcctgcgtgatgcccggactgatgatgacaaactcatccccgccgatccgatagaaatccgcctgtgtgaaggtggctttaatccgtttggcacactcgatcaggacgcggtctccgaattcgtgaccgtagtggtcgttgatgtctttgagcccgttgacgtccagatagacaatccccacagactgcttcgaatgggccagagctccggtatcgacgatgtatttatttctattgtaaaaatcggtcagtttgtcgtaatagcttaagtgggtcagcagctgtttgctttccgaatggcttcttgccagcatcaggaagtagcacagtgtctgaagcagaggcgctatgttccggatccggtcgggcggcggattatcgacacccagatacccgatcagagtgccatcctgctccagaggggcggccaccaggctggtaatcgactgcgcatggagaatctggtattcctcgggcacggattcccggagctgctccatatcctcgataagaacgcactcttttttatcaaaatacgtcatccagcgggtgatcagattgagcggaagatcctgaagcatcatctgctgcggttcgaccccgtcggaacaccattcgtagtcattgtacatcttgccgtctcttatgtagaggatgtaggcccggtcggcagaaagaaaacttcccaggtgctccaggacctgggcgatggcggtgtcaacgtcttcggactgatacagcgtctggacacactccgtgatcatctggttggtctccagcgtcaatttaagctggatcttctctttttctgattctgtggtatcgaaggcaagctccatacgggccgtccgtccctcccattgaatcagccggtcttttaaaatatagtggcgctgggtcagtggattcgtgtattcccaagtgtagatctcaccctccttcaggatcggagaggtgcagaattcacacggcgaatcgaagccctgcaggactttatagcatttctgtccgtccatggtatcgatgtgaaatgtttcctgtccggctttatttacaaataacaaggtgtgatcttcgaggtcggagacgtagacgagttcagaaatctcattcatgggaccgagaaggttatccaccatgtgggagagatgttccttccttttccggtcctcctcctcaatctcctgaagctccttctggcgtctggcctgtccggaactgtacaggtagaaaaagaagatcatcagaacgaagaaacagtttagcaggagcaggctcttttctgccagaagttctcttttttcggaaaactgttcggcggcaagaaccgccctgtcagccagatcaaagtaggattcactgtcctcgaacagaagctcgacatcgcctccggcccggacaagatagatttcttcctttaaaatgctccagtccgcctccatctggagaatcaggtcctgaaactccctgctgttcatgcggatcagcccgtgatcgccgtgccctgactgcagttcatcgagaataccgtccagcttcgcaatcagtacgtcattgggaatgccgttcagctcctccttgacgagtcgctgggtcgcaccgcggacaatgccggcgtagtttatgaccttggcattgccttgaagattatgaaggcacaaaaccgaaaaaatgctggaaagaacgagcgctacagttaaaataacaggaaatattttcttttgcatgggtgcctccgggtacgctgtcatgataaattgtactatctttaagagtaccatatttagcaggctgtggcaaggaataaagagaggacgaagcgattttagccccatcttttctgttgtagacgctggagctctgtgctaaaataggaacagaaacagaaggccgcccggggagaagggagtataccgtggacttattttatcatgagacattcgtgcagagtgagcagatgccgatgcagcttcgcctgcaccgcggacagattaattacatgattctggagcactggcaccggagcattgagatggactatctgctggactgcgaagccgatttttatatgaacgggaagaagaaagccgtctctgccggaagcatcacactgatcaacagcggggatattcatgccctggagccaagagaagtgccggaagatccgggggatgagattcacgggatttcgttgtttatttcctacgaatttctgaaaaagatatgcccggagatcgatcagattaccttcgaactggagggagcggaggaacggctgcatgaactgaaggggatcttcgatgacctgatccgcctggagctgagccctgcggaagagtacggctatttaaagaaaaatgcgctgctccatcagctgatgtaccttcttctcacgtattttaaaggtccgaagaacagctcggctgttaagagccagaagtatattgaccgtctgcgcgtggtgctggactatgtggaagagaactaccaggaaccgctgacgctgcagggggtggcggaccattttaacgtgtccatggagtatctggcgagaatattaaagaagtatacgggcaacacattcaagacgcatttgaatcaggtccgcgtcagcaaggcgttccgggatctgctcgagacggattattccatcctggagattgccatgcgcagcggatttccggatacccggtcctttatcaatgtttttcgggacacgtacggcatgacgccttcccagtaccggaaaaagaaccccaggcgggagaccgtgaaggaaaacgcctctgccgaatatccgccacatatcagggtggtggaaccacagaaagacaacaattagtatccgcccaggccgtggccggcagattgctggagcagttccagcgtctgccggccctctcttaaggagcgtttgaaaaaaatgtcaagaaacgtatctgttttcaataaataatgtaaagatttcacaagctgaatccgatacaattagaacataagacgcgtccttaacaaaaaaagagaggttatttaaaaatggagaaaatttcgttaaaagaacgattcagctatgggttgggagatttggcctgcaatttaatgtttcagctgattacggcgtatctgatgtttttctataccgatgtggcggggatcggactgggagccatcagcctgattatgctggtcgccagagtggtggacgcggtcacggatccgatgatgggggtagtcatcgacaagactcacaccaaatggggaaaggcaaggccttacgtgctgtggatggcggttcccttcggaatcatcagcgcttccatgttcctggtgccgaatttcggcggaacgggcaaatttatctacgcgctgatcacctatattctgttctgtatcgtgtatacagccctcaatattccatacagcaccatgctgtcctgcatgacggatgacgtctccgaccggctctcctttaatatgtttaagtctctcggagccagtctgggcggattcatcgtcatgggagcgaccctgacgctggtcggcatgatcggccagggggatcagaaaaaaggcttcttcggtacggttgttctgtacgcggctgtaggcatcatacttctgatgatctgttttaaaaatacgagagagcggatcataccggagacggaaaaggattccgtggcaggcgccataaaggttgccgccaaaaacaaatactggctactgctctgcggaatcaccttcttcacctttgctggcatgattctgaaaaatcagtccaccatgtattatgcaaaatactacttaaacaatgagggaattgcctcccttctgatgacgattccgacgctgctctctttcctcatggcatttgtgatcccgactctggcaaagaagatcggaaaacgcaactgcattctgtcaggcggtctggctaccatcgcaggaaaccttgtggtgctgatctccaaaacgaatctggccgggattctggcgggtacggtcttatgcggaattggcctggggctcggaatgggagtgacctttgtcatgggagcggagactgtggattactcggagtggcagacgggaaggcgtccgcagggaatcatgaccgccctcatgggcttcggcgtaaagctgagcatggcaatgtcgggcgtggtaggcgcccagatcttaaaattcggcggctatgtggaaaattcggtgcagacagaaggcgcgcttcgcgcgattcaaatgaattatatctggattccggtcatttttttcatcgtagtggtcatactcagtctgttctatgacctggataagaaatatgaaaaaattctggctgaagtacatgaaaggagacattaatggagaaaaaatggaacgaagcagagatggagggctaccgtctcattcacaatgagggggggaaggatctcggaatctcttccggaagtaaggtgacaattataacagaggatggcttcgccttcaaggattttctcggaacaggcgagctggcggcctatgaggactggagactgcccgcagcagagcgggcggtggacttggcttccaggctttcgatcgaagatattgccggcctgatgctctacagcgcgcatcagctgattccggccagggggccgcttgcggccgctttcgggggcacgtacggcggaaaagcctacgatgagagcggagcggacccgtgggatctaacggaccagcagaaggagttcatcgtaaaagacagggtgcgccacgtgctgatcatgaagctgcaggacacggagactgcggtcaaatggaacaaccggcttcaggccctggcggaaaacaccggctttggaatccccgccaacaacagctcggacccgaggcacggggcgggtgttgcggcggaatacatgggtgtgaccggagaacccatatccaaatgggcgaatggaatcggcctgactgctgcatttgagccggaggcggtaagagaattcggggagatcggcgcggcggaataccgggcgctggggatcacgacggcattgtccccgcagatcgatctggctacggaaccgagatggatgcggtttgcggatacatttggcgaacatacggagctgaccgtggaaatgacgcgggcgtactgcgacggatttcagactacaaagggcagcgaggatggatggggtgcggacagcgttaataccatggtaaagcatttcccgggaggggggtcctgtgaggcagggcgcgacggccactacgcatacggaaagttcgcggtgtatcccggcgggaactttgaagagcatctaaggccctttacggagggagccttctcactgaacggcggtacgaagacggccagcgccgtgatgccttactacacgatttcttacggcgcagaccagacctgcggtgaaaatgtagggaattccttcagcaaatatatcgtaaacgatctgctccgcgaacggtttggctacgacggcgtcgtgtgtacggactggggcatcacccacgatatgggaaagacggaagaggagtttgccggaaaatgctggggtgtggagacactcactgaggcggaacgccatttaaaggctctggaggccggtgtggatcagtttggcggaaacaacgatgccgggccggtgctggaggcttaccggatggggtgtgaaaaatacggggaagaagccatgcgcagccgctttgaacggtccgcctccaggctgctccgaaacatattccagacggggctgtttgaaaatccgtacctggatttggagcattcctgccaggtggtgggctgcagggaatttacggaaaagggatacctttcccagctgaaatctgtgacgctcttgaagaaccgggccggggtgcttccgctcaaagagcacataagggtatatattccgcggcgccatatccgcccatacttggatttcatgagctccatgacgccggatatgcatgtggagcctgccggcaagggcgcggccgccgattactttgtggtcgtggatacgccggaagaggctgacgctgccatctgcttcatcgaatcgccagtttccgtgggctacgatccggaagaccgaaagcagggcggcagcggatacgttccggtaacgcttcagtacaggccctatgaggcgaagcaggcgaggcttcacagcctggcaggaggcgatccgctggaggattttgacgacaggagctatcgcggaaaatggaatactgcggcaaatgaagaagatctggatcttgtccttgatacgaaaaaacgcatgggagaccgcccggtgatcgtatcggtaaacttgaaaaatcccatggtgatggcggagctggagccctgcgccgacgcgatcctggtggattacggggtatccccccaggcggtgctggacgttatcacaggcagatttatcccctgcggcctccttccgcttcagatgccggccgatatggataccgtggaacggcaggcagaggatgaggcgttcgacatggagtgctacgtggacagcgagggccatgtctatgaattcggctttggcatgaatttcgacggcgtgattgaagacgagagaactgaaaaatatgggagacagaacagaaggaggacaaaataatggcaggacagtttcagtatgacagcctcccggtggtggagacgaaggccgggaagctcagaggatatcagtgggaagggacgtatatcttcaagggaatccgttacgcgagggcgaaacggtttcagctcccggaggaagcagaaccctgggagggagtccgggaggcggcctcctatggcttcgtctgcccgatgctgacaagggacaatccgcagggcgagcttttagtaccccaccgctactggccgcaggacgaggactgtctgagcttaaacatctggagccagtctctggaccggagcgcgaagaagccggtgctgttctggattcacggcggggcgttttccatgggaagctccatcgagcagaaggcgtacaacggagaaaatatgagtaaatacggggatgtggtagtcgtaaccgtaaaccacaggctgaacatccttggatacttcgacatgtctccttacggtgaaaagtacgctggctccgccaatgcgggccaggccgatctggtggccgccctgttgtgggtcagggacaacatcgaggcatttggcggagatccgggcaacgtgaccatcttcggacagtcgggcggcggcatgaaggtgagcggcctgatgcagaccccggaggccgacgggctgttccataagggaatgatcatgagcggcgtggcgggcgatattcttccctattctactggcgattccaggccgttaatccgggcgatgctggaagaactgggactcacggaagatgaggccgggcggctggagacgattccctaccacgacctggcagctgcgtataaccgggtgagtcctgcagtcgctggagctggcggttacatcggatgcacgcccaaaccggacgatttctacaaaggagagggtccggcggttggatttacggaacatgcaaagaccataccggtgatggtcggtacggtcttcggagagtttgcgatggcgccgctgccatttaacaaggagcagataccagaggcagaattagatgccgttctcgacaaccgtttccagggccgtgggaaggagctgaaggccgtctttgccgaggcgtatccgggaaagaacccggcggacttactcacactggatacaatattccgcgggccgaccagggaatttgtgcgggcgctggccgccgcgggcggaagtgtgtattcctatttatttgcgctggagttcccgtaccagaatcaaaagacggcgtggcactgttccgatattccttttgttttccacaatacggagctggttccggttgccaacattccgggggtgtcagaccgtctggaagaacagatattcggcgcggttatggctttcgccaggaccgggaagccggagtatgaggggctgccccagtggcctgcttcgcgggaggacgacgaggcgaccatgatcttcgaccgtgtctgcgaggtccgccataaccacgacgaccgcctgttaaagctgcatgcggaagcgtcgccgaagtttgacctggcggccatgatggcgaaaatgggggatgagattcagcactgactgcggtgaaaaatacgaaagataaatggtgcatatcaaaggggggaaagcatttatgctttccccccccccctttgccatattcccgactctgaacctcagacatgtattatttgcaagctggcagtattagttatgttgtcagcatctgtatatttgattgattatattatgtatttatgatagcataaaataagtaaattgataattccggacgtgtcagaaggcgtgataaataaggagtgataaatatggtatccaggcaaattttagacagaattgaccgttatatctgcataaattatatcgctgatacggcagctgcagagccggcagaaagaattcaggagcagtacggcagttatgttccgtgcatgagggaaccccatgcggaaaacagggaaaagcaaataaatattccggatattctaaaaacgaaatcagggacagttacagaatcgttggcagaaagcttagaagaggaagcgccttcgcgaaaggtgcaggcttccttttccataagaaagctggaagatttggcggcacagacagaggaaagcttttctgtgtctgtactgcgtatgattgacgaaaaaggtatgacagatgtggaagtttataaaagagcgaacatagacagaaggcttttttcaaaaatcagaagcaatccggattattcgccgggaaaacagacagctgtttcgctggcacttggtttgaagctgaatctggacgagaccagagatttgcttgcaagagccggatatgtgctgtcccacagcaataaatcagatattattgtggaattttttatttccgagggtatatacgacataatgaaactgaatgaagcgctgtttgcgtttgggcagcagccgattggaggattatgaaagaaaatgtcgcttttacggcgaccttttctttttgtttatgtggtaatctctttttatcaaatacaggaggtcgccattatgaggaaaggtttgacagagattatatttatactggaccgcagcggttccatgtcgggactggagtcagatacgattggagggtttaattcactgatagaaaaacagaaagaggagggaagtgaggcctgtatcacgactgttttgtttgatgacaaaatcgagcttctccacgacagaaacaacctggcggagctggggccgatgacggaaaaagattattttgtccgggggagcacagcattgctggatgcagttggggaaactgtccatcgtatggaaactatttaccagtatgcaagagatgaggatatacccgaaaaaactatggtggttatcacaactgacggtatggaaaattccagccgaagatattcttacagcgaagtcagccaaatggtaaaactcagtcaggagaagcgtagctgggaatacatatttcttggcgctaatttagatgcggcagagaccgcatgcagaattggaatcaggcgtgaccatgcggcaaattatacgtacgatggaaagggaattcagtgctgctatgactcggtttctatggctgtaaagagtatgcgcagcaataaagagtgtcccattgagataccggaatttttgaaaaaagtgagggaggattatgaagccagatccggagcagtggagaaataaggcgggcagtgatccggaaggacttatgcgagaagagaggaattaatggggcgtgaatccatgaaaatggattcacgccccgtcatatgacagcagatatggaaggatcaatcattcattattcggtcacaaccgaataacctgctccgagccagccggctccgccttcttttcccatgcctccgcttaaggaataggcctcatagccgagcagtcggagaatagccatggtctgggaagaggtctgtccgctgtagcagtatacgacgactggtttatcagtcggaatttcggaaaaatgttcctgcattcccttgccgaacggaatgttcatggcgcctgcgatgtggccctgcttatagtcgtcctcacggcggatggagagaatcgtataatcttcgctttccgcgtcaaccagttcttttaaggcttccgccttgaaattaaaggaagcgatggtgttgctggtcgcctctttgtagtaatcggcgatagcggcggcgatggccggatctacttcataggtgtcatcaggaatgacggcttcctcggtgtcgatataggcttcgtagccttcttcctgggaaatgccattgttccagccgctctgaatgttcgtagcaaattttccggctgcgtttaagagggctaccgtctgagaggaggtctgaccggtatagcagtttacatatactggcgtatcatccgggattttatccagtgattccgctacagcagcaccgtaagggatgttccacgctccttttaaatgtcccgcggcgtagtcatcaggctttctgatatcgatgataaccatgtcttcaccggcgtcgatttttgcaaagagatcggctacagacgccatatgcttatcttccgggaagtttttaaaatagtcagtagcggccgcagtgacggtatcctctgtttttgcggctgcttctgtttctgcaccggaggtctccgcgggcgcttctgtggtttcttccatagctgcggccgtcgtctgaggggcagcagaaggtgcttcctttacggtcttggttgcacaggcggtcagactggctgccagggtgagcccaagtaatacaggtacaattttcttcataataattctccttttggtgttaggatgcgtttttctttaacggagcagattgaccggccggcatctcaaccggattatcagagttggaagaccattctaaataggcgccgtcatagatccggatgttccggtatccagcctcgtacagctgaacaaagaccggagccgcccgcatggacgtctggcagtagagaatgatttcatcctccggataaattttttcttccaggtagttaattctggtaatctgcgttgtcttaaatgttccatccgagaagaaattggtctcatagggaatgatcagggatgtcggaaccttgccgacctctgcgtattcctcaaaagaacgaacgtctaacaaaatggtgtgcggatccgggttctcagcctgtgcgcgaacctcgtccatcgttgcgagccagttggctgacggctccttcgcggtaaaaacagcctcggcaggagcctcgatatcggtgctcagctggatcccggctgtctggatggcgtcaaagcctccatccacaaccttaactttctggtgaccaaacatgaacagactccagagaaggcgggaggcgcccattttattggcatcgtacgccaggactaatgtgtcattggagattccgttgctgcccattaccttttcaatctttttctggctggtcagcatattctttaccggaacattgataacaatgtcggcggtgggaatattgactgcacctgctacgtgtcccgcggcatattcctccggggtacgggtatccacaacgaccacgttggactgttcggcgtagccgggcaggtccttcgtggagacgatcagggactccccttcgacaaaagtatgagagctgcagcctgtaagagccgctgccagaatcgccaaaaacgaaaagattgttatttttttggcaaataagcccataaaaccctcctttataaagcgagtaatggtagtgtgtagtaaacgctgttgttttgcgtgaaaataagggcctcaaccttatttccatgtaattccaagttttattatactgtaacagggctgatttctggtataagaatccgttatattatatctgttaatcggataatgctaaaactttaacgaaaatcgtgataaaataataacgaaaaaatgcgaagaaatcataaggaggcagggaatggaccgatggaagaaatgggcggtgttttgtgccgcagccgtgtacctggcagtctacatatttgtatcataccggaatcttctcgtatttccatttgttcattcggatgagagctggctggccggtttgagccgcgatatgctggcggctggaaatttaggagtgacagaaagcttttttgatgcgaaaccccgggtgccccacgcgatgaaaagcctgtttcatctcatgcagatgggagcggtcgggctgggtggtttttctgttggaagtgtgagaatgctttctcttctggcggggattatctgcctcgttctgttttatctctgcgtgcgccgtatgggaagcaggtggtttgctctggggcttactgttctgctgagcctggatattcagtttatttatgcctcccattttgcgcggcaggagatttttattgcgctggagctgctggggtgtctctggattctgcttggaaaaaaagggcggccggggacaggaaccgcgctgatcctgggagtggtcacaggactttttgtcgggattcatccgaacagctttttgtgcgcggcggtctgcggcgccattatggtgtttgaaatcgtaaggcaggcggcgggaaaggataaaaagggggcagtgaagacattgggcagtctggccgcctatacagcggcggtgctcgcggtgactgccgtctatgttggtatcagttttcagttcaatcctcattttctgccggactactttttgtatgggaaagaggagtttgagctgtcgtcctccggctgggcgagagtcggggagctgttttcatttttcagcggcgtatacgggcgggataacggaacctattatcttcccgatgttcgcctggagatgattgccatggctctggcggcaggattatcggccgccgcgtgtctggtcatgagaggggatgtcttatctgagagtgaagcgttgacaggggagagtgtttctgacagcgaagagaagcggtggatacaaaataccagggtgattctcgagggggccgcagggcttgcggcgggcatggtggtgattggccggtataatcagacggctgtcctgtttttcttcctgtttggctggctctttgcaggccaggtcctgcagctcttcgagaaggccggccgtacgatcggaattctgatacttgcggccggtcttgccgtggggagtatctggcagatacagaaccagcggcccggggaggcggagaattacgcttcgtatctcgatcagctggccgaactggtgcctgcggatgcccccacaatcggaaacctgaatatggagttttattttgacagagggatgctgaaggattacagaaaccttccttacgtggaaggcggggtggaaacgtatatcagggaaaatcagatcgagtatatctgctattctgatgagctggactatctctatgagcacaggccttacttccatgcgatttatggaaatacagcgtttgtgagggagcttaaggcgttttgtgagacggcgtgcagggaggtcgggcggattcacagcctggagtatgcctcgcgggtgaattccctgagaggtgcggaggaatggggaacggtgagagtgtatcgggtgaaacaggaaaaacaggaggacacttaagtcctcccatggtcttagccctcgcaggcttttaaaacactccttgatacattcaggcattttcctccagcattttttccagcgtttctgcctccggcattgcttctttggaaaaaacggcggatatgccttttttctgtctggacatgacggcgatatgggagccgagcgtgcgggcttcgcggatatcgtgagttaccagaaggatggtacagccggtttgggcggccatggcggtgacgacgggatataaggcctttttggtggcgatgtccaggctggaaaagggctcatccataaggaggactttgggctttaaggacagagcgcgggccagcgcggcacgctgcttcatgcctccggagagctggtggggataggcgttttcaaagccggacaggcctgccatggataaatagcttcgggcacactcttttctctcggccaaagtgcggaagagtccgactttcttcatggcataggtcaggttgccgagaaccgtgtaccagggaaaaagctgatcgaagctttgaaataccatcatgatgtctttcgacggagcggtgatttccgttccgtctagcaggagagaaccgctgtccgggcggtcaaaacctccgatgagccttaacagcgtgctttttccgcagccgctgggaccgacgatgacaaagaaatcatgatcgcataccgtcaggtttaaatggtcaatgaccgtatgagtctggctgcttccggtgtaggagcggctgatgttatgaatttccagcatggtttcattcctttctaaacagatttcatcccccatttggtgagcgtgcatttctcaatgaccgagaacaggccgtcttcaaccagcattccaatgaaaatgacaagaataattccggcgaacagtcccgccgtgttcatgaaggtgcgctgagtcagaatgtaccagccgatgccgcctttggcgcctactgctccaaagaccatttcggcgctgatgaaggccctccagcccctggcccatccgatgcgcaggccggagattagatagcccagggatgcgcgcaggcggatctctacggtgatagcggcggaactcatggaaaggctgcgccccatatcctcataaatgccgggaaccgcgttaaaaccggccaggagattgaccagaaccggccagagcgcagagtgaaccacgatggccgttaccgccccggtgccggttccgaaccacatgataattaacggaagaagagccaggcccgggagcggatgcgccagggcggtcagggtatccaccagactgtatatcagccggctctgtctggaaaacagggccaggacaacagccaggacggcagaaatgataagggaaaaggcgatgattcccagggagtacgcggactgccagattaagtccccctgcgtgatgccctgaatcagggtggcgcacacctgttccggggagggaaccagaagtggggaaacgttcgagatccggcagaatagttcccacagcagaagaaagaccgagatccagaacaggcgcccggcccatttcttttttgttatagtgtctaaaaaacgttcagtcatagtaaaaattcctcttttttacactctagtggtgaaccacgttatcaaaaaacagactgtctgccggcagctcctctgagagaaagcccatctcagccatctggcggttgaagatctccactccgttcagttcgctggaatagatcgtgccgtcccggcccatctgtctgtaaagttcctcctgagaaattccatagagaggtgcgagaagctgggaggcttcctccatattgctgttgatgtaatcgatggcttcctgaagggcatcgatgactgcgtcgtaatactcccggcggttgtcgtgaaactcctccatagcaacgccggtgataaatgtaaacggctgcccgacaatctcctcccccgtggccatcacgtgcataccgccatcggactcctgggtgatatagggcggtgtggaaacgtgtgccgtgatctcggtcgcggagagaagggcgtttacggaatcgggatggctcatggagaccagctggttgtccagggcatggggatctcccagctgctggccggccagcatgcataaaagtacgtgctgggtacaggctggggacaggatcgagatccggtctttgggcgtcagctcggtcaaggagtgaatgtcgttccgtgtgacgatggcgacctcattggaactgattccggtggcataacgccatttcatgccgttgtcaatgccgattaggaccggagatacccccataaatccgaaatcgatctctccgttcatcattccttcgcggatgccggtcgggccgccgaactgcttccagttgatttccacaccgggaagcctcttttccagaagcttctgctccttcatgatctgaagcggggcataggcaatgccgtactgctcggcgattcccacagacggcgcctttttcccgccgcatccgggcagaatgaggaccgccgctgtagagagaatgagcagagcggatcgtatgaatgaggggcggtgccttttgccggtgtttaaatcagctcttatgtcagcgactatgttagagttcatgtctgtgtacatgtctgtatacatgtctgtgttcatgtcagtctcctttatgcagtccataaaaattcgtgatcatctcttccccctgtgtggaacggacggacaaacgatgataaaaatcatggatattggcggaaatatttgcgtcatctccccagaggacggcgtggccgaagcgggcggtggcattttccatggcggggatggtctggccggggagatagttgtagccggcatccagcacgtagggcagagccagaagtttttctaaaggtgtgatgcttaaaatgtcgcctggccggcagaataagagctggaccgcgacacatcgtccctccgcggccgcttccaggcagtccatagaggggggctcggccggcattccgagagcgctccgtatcacggcacccaatatgtcaaagcccgttaagaaagggataaagacatcctcgaaagcgcctccgatccggctggccagttcgttgacctgaattccgtcttttccgaccagcagctgaagatagaaggggccattggcgatgccgaatgcggctgcggttctgcggctgattgactcaatttccgcgtaccggtccatgtgaaccgtgggaaaacgatgcccgacgcagactccgatatggaccggatccggatagagaaggcggtccgtgacagtcaggatatggagtttgccctcatggagccatccgctgaccgtaatctccgtgctctcgcagaattcttccaccagtgcctccggttcccgggaataggagagtgtgtcctccagatgggagaagacctcctccggcgtattgaggcggtagattccgcgctgcccctgggaatccagaggctttatgacatagggagactgaagtccgtccagagagcctgcttccatgccctgatggataaaacgaaaacgggcggcaggaataccggcctctttcaggattgttttcatatgctttttgttggttacggacagcgcttccccgaccgacagaagcgaaggcagatttagggcgctgctgacagaagctgccgtgtacaccggctggtccgttcccatggtcattaccgcgtctgcgtggtgctctctggccgcccggatgcagccttctatatcgaaggtgctcaccggttcatggagtcccgcataccgtgctccgctgggcgatctggtgtaatcggccagaatcgtgtccagccccagcgtctttgcccgctggaacgcatgaacctggcagttggagccgccgaggatcatgagccgtggggcgcggattcgccgggatatgcggtagagcggttttgcgccgcggctgcaattccgctttgcagcagagaagcacgtataatttagaaacagctttgtgtacagccgcagcagtgagagtgcgctgtagccgctgatgattttctctgcagatttcttttgaaaaagagcatgattccaatcctcttcgccgttagattctctcctgtaaggaatggatacggccctcaccggtcttgtgctccctttaaaaacagaggcggacagataaaagaatccgttgggtttcaggcggcaggcttccttcactaagtcggctgtcatgatccgaaggctgctgacgcgaaccccttccggcacgcccagaaacagggagaacaggccgtcgcgcatgtagcttcctgcccttcggtaaagagaacggcgggagacggcggggactccgtatacgatgtcatatccctgccggatggtgtcgtaaagggccgccagcatttccggaggctgttctaagtcgtcgtcaatggtggcgtaataccggcacggatccaggtgctccaggccgcagagtgtggcggcctgctgtccgtaattgcggtccagaaccagaatcgcggtctctggagaacggcatatcccggccagaaaagccgcggtttccggcctgccgctgtcatctacgatgcagatgcgaagagtgagtttttcagaaaataattcccgtatacggtccgttaaaatcccgatggattcccggggccggtatacggggatgatgatgccgagatcgtaaatcatggtaaaactccttatccgttacacgaaccgcaggatcgtttccgttgtccttgcgatatcttcatccgtcagggccgtgtggaccggaaggcggagaagtgtctgataacaggccagcgattcgggtaaatcttctttgtggtatcccagcttttcccccatgggggaggcgtggagagggacgtagtgcgttttgcagtcgattccatgggccgccagggcggggatgagagaattcagcagggcgggatcctgaaaacggagatagaaaatatggccgttgggccgggcataggcgggaatctgcatacgcatggcgattcccctctcctccaagggagccagctgcttccaatactgttctgtcacgtggaggcggctgcgggtaatctgggaaagacactgaagctgcgccaacaaaagggctgcctgcggttcgcttaaggcggtgcaggagccgggaagattccaggtatagcgggcagcttccccgtctaaatatcccgcccggttcgttccgtgaaggcggtactggcgcgcatactgccaatggccatggtttttggtgatcatcaggccgccttctccgcagacggcatttttggtgtgatggaagctgacgcagcccatatcgccgacggtcccaaggggctgatcctcataataggcgtccacacattgggcggcgtcctcgatcagggcgatacccgcctcatcggccagcttttttaagccgccgaggggagcggatacacctgcgtaatgcatggcgatcacggcccttgtgcggctggttaagcgattggacgcgtcccggaccgagatgttctgggtatcgggcgtgatatcgcacaaaacgggcctgccgccgtggcgcagcacggcattggcggcagacgggaagttaaaggaaggaagcaggacctcatcacccggatgcaggcgtaagcaggccagagcggtctccagggccagcgtgcagctcggggtaaagagaaaacggcagcctggatagaggctatccgcgcagtcaagcagccgtttcatgaataagccatccgtctccaggccggaggccaggacttcttctaaataggcggattcaagaggcgcatgaaagcggctgtaaaatgaaatatccataataatccctttcctctaccgcggccgcctgaattatgatacactatagccatcaaagaaatggaggcgctgcgtgatgcatgaaatcgattgtctgggagatatgtgtccgattcccatcatgaaactgaaacaatgcagggagattaaggaacacggcggccagatcaagctggtcacagaccacagctgtgtggtggaatccataggcagctactgccggaaaatgcacttgaaaatggagacagtagagccgatgaacggaatctgggagctgtatattacagtctagcagatgcttttcgtaacaatggagataaaatacaggattattttttccagagcaggattgtttttgaccagatgtggattgtatatggaatacacatcgtaattcaaatcgaaatccataacggagatgatctttatctgcttctggtatacttccttctttactgttatgtagggaagaaacgcggctccatgtccggcaagaactgtgctctttacagattctgtggagtcgagatggtacatcacccgcagggtgtccaggggatgccctgcctgctttaggtactgatgaagcagacggtaggagctgaactgctcgttcagcatgaccagggtgaattttttaagctcagacagtgtaatgctgtccgggcaccggtagtcttcgctcgccaccagacagatcttatcgctgaaggccaggttgcagacgaattcaggattatctgtggcgcccacgataaatcccatgtccgcctgcccgtgccccacgcggtgaatgacctcggtggaggggacggaatttaaactgaaggagtagctgggatatttgtggttcaccttgaacagggagcagggaagcgcgtagttgcaggccacgggagtggccgcgatacgaaacgtcccgttgtaggattcaaggctggcgagttcctcctttaaattggagtaggtctctaaaaattgttccgagtatttctgcatgacctctcctgctctggtaagtatgatcccgcggttggaacgttcgaaaagttttacgcccagttcctcctccagccgctgcatctgctggcttaaggccggctgagagatgtggatcgcctgggctgccttggatatactctgttcttttgcaattctggaaaacatggaaatctgttctaaaagcatttgatccccccctcattgtttcatctctgttattccggtatcatttctatcattcattatacaagaacgttaaaaaaaacacaatatcgccataaggattgtttatagcaaaaaattatacagtataagcaacttggatagtgaaaaaaatgacaatgtgctatactgtagaggtgtagtaacgcgttcaaatcctcaaaaaacaagaaaaaaggaggtgcaatgaatgcaggaaaacggaacagaaacgacaggaagtatccgcagaagccagacctcaggaggctcgtcaagaccacggaagaagaaaaagaatcagcttcccattggatttggagtctttttggctatcatagtgatcggaatactcttaggatttaaaaacggcacgctggctcttttctgggcgtttgggtgctgcttcggttttattttgcagaagtcccgcttttgctttaccgcatccttaagagacccgtgtattaccggatcaacgtcgattacccgtgcggttctgattgcattcgccataaccaccatcggcttcgccgcaattaaatacggtgcatttgtaaacggacaggagattccgggccagagttatatcatgcccatcagccttgccacggcagtaggcggaatcatgtttggtatcggtatggtaatcgcaggcggctgtgcttccggcacgctgatgcgggttggtgaaggctttgcaatgcagatgctgagtctgctgttctttgtaatcggatccctgatcggcgccagccatatgggatggtggacagagaactttatcgcaaccgctccaagaattttccttccggatgtatttggatgggcgggagcagtgattttacagttagcaacgattggcctgctctatatagcggctgatttatatgaaaagaaaaaaatgggaattgaagagtagaaaggagatattatcatggcagaatttacaattgattgtttaggcgaggcttgcccggtaccgttaatgaaggttcagaagcagtgtgagaagatggcggtaggtgacgtactgattgcgtcaattgaccacagctgcgcgatgaaaaatgttccggaatgggccagaaatcagggatataacgtagagatcgaggaagtggacgacggagaatgggaaatcgtcattgaaaaaacaaaatagaaaggcgtgggtgacactttgaaggctttttgggataaagtgagtaaaaatccatattataaaaagattttcaaaaatccatttacatatgtcacaggagcggtgctgctggccgtcttccagatcgccatgtttgcgtctaccggttccccctggggagtgtccggcatctttgccaactggggcgcatggctgtaccgtctcgtgggcggtaatgtggataagtggtattacttttcttcagaaggcgcacagaacaccttaaacagcggaatcctgaatcatccaggatcctggcagaacttcggtatcatcgcaggagcgctgctggctgctctgctggcctctcagtttaaattcaaaaagattaaatccttaaagcaggtagtggccgccacgttgggcggactgctgatgggatacggcgcaaggcttgccggcggctgcaacatcggagctcttttttcagcgatcggctccatgtcgttatccggatgggtatttgcattctttttgtttatcggggctttcattgggagcaagctgttggccaggttcttcatgtagcgtcgcaatatcggaaatgaatctttgaccgctgcaactctttgacagaattgcggcggtttttgcgtcacgggaaactgtttatgaagcagatgagaatcataaaacatatttcctatagaacagatgacaatcagtacagaaaggcaggaatcattttggaaaagaaaatagagcaatacgatgtggtaattatcggcggcggagcagcaggtctgacggccgccatctactgcggccgtgcgaggctgaaaaccctggtgatcgagaaggcgctggtaggcggactggctacctatacgaacgagattgaaaattacccgggatttccggaaggcagtacaggtctgggcctgatggagctgttccacaaacaggccaagaaattcggcgtaaagttcaaactgaccgacgtgcgcgcggtgcagcttaagggagacaaaaaagtagtggagaccttccggacagattatgagtgccgttccgtcatcattgccagcggcggcaagcccagactcaccggcgcgccgggggaggacaaattcttatacgacaagggcatttctttctgcgccacctgtgatgcggcggcgaacacgggaaagaccgtcatggtcatcggctctggagacgcggccatcgaggagggaatgttcctcacaaagtttgcgagcagagtcattgtcagcgttatgcacgaggaagggaagatggactgcaacgagattgccagggaagaagccctggccaatccgaagatggagtttatctggaacacgcttccggcagaattcagaggagatgaggaacatctccgcagtgtggcattgcggaatttaaagaacaacgagatcatcgatgtgccggtggatacgtgtttcttatttatcggttacctgccaaataccgagatattcaaggatatcatcgatttgagccgtgcaggctacgtgatcaccaatgaaaagatggagacaaacatgccgggcgtctttgcagcaggggacgtaagggataaattcttaaagcaggtggctaccgcggtcggagacggcgcgatcgctggctatgcggcggagaaatacctggctgagagcgaagtattcgaaaaacagattatggacccgaccgtaccgggtgtggtttacatctggaatgccgtggagacggccagccgtgagctgcttcctgtcatcgaggcctttgaagaaaagcatgcgggcagcgtgaaggtgacaaaggcggatatctataagtctacaggcatcgccagccgtctgggcatcagcggagcaccggcagtggcatttataaaaggcggaaagcttgcgggagtgttgacagaagggattacagaagaggcgcttgaggcggggattcggtaagagtaactgatcagaatgttatagcctggcagaggcaaaggcagataaaaaactgcttttgcctctgtccattttttttacatcagggaactggatcgtaaccaccattcggtaagatagacaatacagatgctttgattaatgaattgacatcatttccgcaggataatagaataaagataagccataaagataaagccataaaggagatgtcatgagcgaagataaaatcagatccaaagcactggcccttgtaatcattctgctggccgtcgccctgtacaacaattaccgcatgaagcaggaactgaacaatatgcgaagtgagatgagcagtatggaagccgttctgcgcaatgaaatcaacggagtccgaaacgatgcggatcataaatatgagagtgtggcaaagaagattgagcaggaggcgagcctgttttccgatacttccataaatatggggatgcaggacggaaagctgctggtgacgatgcaggcggttcccaaagcgctggagaagaatgaaaccgtgactgccagtctgactgcggacggaaccgtataccggcaggcgcttgacgcagagaatcaggcacagtttatgctggaaccggcagaatggctggaaccggcctttgtaattgagtcagagaccggataccgtcaggaaattctgaagcctgtgtataccgttaataccatgctggcgcgggcggaatgtgatttttatgattccggggcaaacgatgaggggatgtttcatttctggattacgggaaatacagatggaaatccctttgaagaggacgagatcgcgatggcagaagcaaagattgcggcaaacggtatggcagaaagcccgggaggaaatggcggctcacaccaggaatcaggttatagtcaggcagtctcggaggcacaggtcgtagaagtacagcctgctgcatacgaccaattggcaggggaagaccttacccttacgaagctttcaggtgggaccgataaaatagtgggctaccggatcgacgtgtccgattatataggaagaaaagacaacgtgaattacgaagtttatctgcggattacgttgaaaaacgggctccagtatgtgaccggaggtcccctgatttcatttgcttctacggagaacagctcttccaggagcgggggaagtgagaatctggtgccggtattggatttttagtaatccgacaaataaacagatataacaaaaaaagattaccaatttgtgggaaaatgtagtagaatatgagaaaagcagtcagaaaaggagaattaaaatggcattctattatgaggaaccgtccagaacattcagcgagtaccttctggttccgggctattcatcgacaaagtgtatccctgcagaagtaaatttgaagacacccctggtcagatataaaaggggagaggaaccggcgctgcatattaacattcccatggtttccgcgatcatgcagtcggtgtcggacgacagattggctatcgctctcgcgcaggaaggcggtctgtcttttatttatggatctcagactattgccgagcaggcagcgatggtgaaccgggtgaaacggtaccgtgccggttttgtagtaagcgattccaatgtatctcctgagatgacgctggaggacgtgctttccctgactgaacggaccggccattcgacgatcgccgtaacggaagacggcggaccaaacggcaggcttctgggaatcgtaactaataaggattaccgtgtgagccgtatgacccctgacacgaaggtaaaggaatttatgacacagatcggtgacctcgtctatgcggatgaagacaccactttaaaggaagccaacgacattatctgggaacacaagatcaattgtcttcctctggttaataaagaaggacagctggtctatctcgtgttccgcaaggattacgacagccataagaaaaatgaaaacgagctgattgacagttccaagcgctacatggtgggagcgggtatcaatacgagagactatgaggaacgtgttccagcacttttggaagcaggcgccgatgtgctctgcatcgacagctcggagggcttttccgagtggcagaagatcaccatcgactatatccggaagaattacggacagagtgtgaaggtgggcgcaggcaatgtggtggatgcggaaggattccgtttcctggcggaggccggagctgatttcatcaaagtgggtatcggcggaggcgcgatctgcatcacacgtgaacagaagggaatcggaagaggccaggcaacttctctgatcgaggtggcaagagctagagacgcctattacgaagagaccggtatctatgttccgatctgctctgacggcggaattgtccacgattaccacgtaaccctggcgctggccatgggcgcggacttcgtgatgctgggcagatacttcgccagatttgacgagagcccgacaaagagagtcaatgtcaacggaagctacatgaaagagtactggggcgaaggaagcgcgagagcgagaaactggcagcggtatgatatgggcggagagaagaagctttccttcgaggaaggcgtggactccttcgtaccgtacgcgggaagcttaaaggataacgtgggtctcaccctgagcaaggtgcgctcgaccatgtgcaactgcggcgcgctgactattccagaactgcagagcagagcaaaaattacgctggtttcatcgaccagtattgtcgagggcggggcacatgatgtcatgctgagagattcgaaataaaggggagcggattgcatggaatatttcaaagcatccgaagaccacgcagagcagatttataatctggtacagaacaccattaccgcggtctatccccggtactatccggaggcggtggtggatttcttttgcagccttcacaacagaatcaatatcagccgggatatagaagacggctgtgtgcgtgttctgtggagcgacggccggatggtgggaaccggaagctgcaaaggcagccatatcaccagggtcttcgttgccccggaatttcagggacaggggtatggcaggcggatcatggagaacctggaacgtgaaattgcacgggaatatccatctatatgtctggatgcgtcccttcccgcagctcacttttacgaaagcaggggatacaagaccgtgagacatgggaaaacagaggttgagaacaacgccatactggtctatgaagtgatggaaaagcaaatgactaagaacttataagagaaaaattaaaagagcggttagctgcgcggcggataatacaatgtccgccgtgctattgttaatatggaaggcgtttaacttaacagatcattcagacaaataatgttacaccccttgcttttataataatgcagcatctcatcaatctttcttttgtcataactggtaatgcagtctgacagcacactcacgccatagtctgccttgcgcaggttgtagcaggtcgatttgacacaggcaacagcatctgctcctgcaatgtagaaatcacatagttcattctttctgatataatctgtaaattcaacagagcttaacgcattccctttgcattttgtaaaaatattgtctgataccatcttcaagtccgaagctaattcagatccgtaggtatccggtttaaatgtcctcgtgcctgcggataaattttcatgtctgatataaataacatgaatttgatgattggctgcccaatcgatcgcttgattgatattgccaatcacatccttgtaattctttgttatatcattttgaatatcgattatgaccagggtttttttctgcatggtgtctcctcctgacaggtagtatattttgtttgcttttttattatagcctgtaattgttgacatcagtatggcagcaatctataatgagaaaaagaaattttggaaggcggatgatccgatgaaagttgacaggcttgtgagcattattatgatactccttgataaaaagcgtataggcgcgcaggagttagccgatctgtttgaagtttcaccccgcacgatctaccgcgacatagatgcgatcagcatggcggggattcctgtttgttcgatatcgggagtgggcggcggctttgaaatcatgcaggaatacaagatggataaaaaggtcttttctgctgacgacctttccgctctcttaatggggctgtccagtctttccaacatcgtgcggggagacgaactggtacacgctcttacgaaagtcaggagctttatcccggctgacagagcaaaagacatcgaattaaaggtaaatcagatatgtatcgatttaagtccgtggacaggcaacagcagcatacagccatatttagaaattatcaaatcagctttgcaggaaaacaggctgctttcgtttgaatatacagcccaccatggaaataaaaccgcacgaacagtcgagccgtatcagcttgtattgaaaagcagccattggtatttacaggggtattgccaaataagacatgatttccgcctgttcagactgtcccgtatggcagacctgcaaatgcaggaggaggcttttgtaccgcgggattatcaaaaaccggttttagattttgcggaaatgctggaaacgatgcagacaaaaatcaaaatccgtattcatcaatcggtgatggaccgggtgcttgattattgctcttatgaagatttctcaccggacggtgatgatcattaccttgtcagttttcctttcatagagaacgagtaccactacgatattcttctcagctttggggataaatgcgaatgcctggagccgctgcatatccgtatggaaatgaagcgaagaatacatgatatagcttccctgtacgaaaactgatattacattttaccaccattttgattgcctgctaaaattttacttgactgtagggttaccttatagtttatgctagggggacgcgagtaaatcgttaagatattttcatcaggaggaaacgggctttatatgaaattaattatccactacttaaaaaactacaagaaaatgtttctgctcaatgtagtctccgtactgggctttgcgcttgtggagctgggtattccgacaatcgtggcacagatgatcgataacggagtaaaccgcggggatccggcctacatatggaagatggggtttctgatagccgctatttcttttgccggagttgcaggcacgattttgctggggtactgctgtgcctatctttcgacctctgtcaccagagatatccgaaatgatattttcaggaaaactcaggaattctcacacagtgagttccacgaattcggcatcgcgtccctgattaccaggacgggcaacgatgcgtttcagattcagatgtttatgaatattctgctgagaaccgcgctcatgacgccggtgatgatgatcggaagcatcttcctggttttacgggcttctttaagcctgtctgtcgttattctggcgacgattccgctgattgtaggcggagtgattctggtggcaaggatttcggagccgatcagtgagagccagcagtcctccctggaagacatcaaccggatttccaaggagaacttaagcggtatccgggtaatccgtgcatttaccaacgacgagtatgagaagaagcgcttcgacggcgccaattcaagctatatggggaactcgaagaaactgtttaagctgatgtctgtgactcagccggtcttctttcttcttatgaacttagccggtatggtaatctactggattgccagcattatgctcagcgagggaactctgcagatcggtgagctggtggcgtttatggactacttattccatgtgatgttctccattatgctgttctgcctggtctttatgatgtacccgaaggcagcggtcagcgccggacgtatccagaaaatatttgacgcagagccgtcgattaaaaatcctgaaaccaatgtgcagtcgttagaccacatcgatgatatcgtttttgaccatgtggatttcgtttatccggatggtgaggaagcggtgcttaaggatgtgtcattttcggtgaagcggggagagacgatcgcctttatcggaagtaccgggtcaggaaagagtacgctgattaacctgattcccagggcttacgatgtcagtgcgggccgtgttctgatgaacgggaaggatatcaggacgtatgatttggagagcctgcggcgcgccatcggttttattccccagaaagccatgctgttttccggaaccattgcggataatctgcgtttcggtaaaaaggatgccacgatggaggaactggtccaggcggcaaagaccgcgcaggcgtacgattttatcatggaaaaaggcgggtttgaggaacatatcacggagagcgcaaccaatgtttccggcggccagcgccagcgtctgtccatcgcaagggcgctgattcgtaggccggatgtctatgtatttgacgattccttttctgccctggattttaagacggatgcgaagcttcgccatatgcttaagaaggagacgggcaacgccatcgtcatggtggtggctcagcgtatttccagcatcatggaggctgaccagatcatcgtattgaacgagggcagtatcgtggggacaggaacccataaggagctgctggagaactgccgcatttaccgtgagattgcattatcccagttaagtgaggaggaattatcccatgcgtaaaaaaatcaaagaaatcggaaggatgctgggaaaactgaaaccctttctggcgccttatgctttacagttatttgtatctgtttttatgatagttattagtattggggcgattacagctgctccgcggattgaaggaatgattaccagcaggctggccgcggacctggcggatatggcctccggcgcagagggggcacgcattcattttgaagtgattcgcaatatattgctggtgcttctggctatttatcttacgaagacggtttcccagatcgtgggctcgttctgcctgaccaactcgattcagaacgccatgcacgatttgcggaacgaggttcagaacaagatccgccgcctgcctgtccggtattttgacaccaacagcttcggcgacgtactgagccgtgtcaccaacgacgtggaggcggtatccaacgcgctccagcagagcttttcccaggtgatcagcggaatccttaccctgattctggccctgtggatgatgttttccatcaacaagctgatggcctgcatcgctcttttgatcatcccggtgggagcccttatcacccgcggtattgtgcggatcagccagagccagtttaaggctcagcaggactccctcggtgatatgaacggagcgattacggagctgtataccggttacaatgaaatactgctgttcggacagcaggagcagtccagagaacagttcgaggcggttaatgacagcctgcagaaacacgcttttaaggcacagtttctctcttcactcatgagccctctcatttccctgacgacgtatttaagcatcggcgttattgcggtgatcggctgctttgccatcctggccggcacgctgtcggtgggcaacctgcaggcatttatccgttacatctggcaggtcaacgacccgctgacccaggtatcccagctgtctgcccagattcaggcggcatttgcaggcatgaaacgtatttttgagattctcgatgaaccggaggagacggaaagcgctccggcgggactccttccgggaccggcaaagggcgaggttacctttgagcatgtcagcttttcctatggggacacaccggtaatccgggactttaacgtcacggttaagagcggtcagatggttgccatcgtaggaccaaccggagcgggaaagaccacgcttatcaatctgctgcttcgcttctatgatgtaaacggcggacggattctcgttgacggtgtggatatccgcgatatgaaccgggaggacttacggtccatgttcggtatggtgctgcaggatacctggctgttctccggaacaatttttgacaatatccgatacggcaatctgtcggccagaaaggatgaggtaatcgatgcagccaagatggccaatgtccatcactttatccgtacgctgccccagggctataacatggtgatcaacgaggagggaagcaatatctcccagggagagaagcagctcctgacgattgccagggctattttaaagaatccgcagatcatgattcttgatgaggctacctcctcggtagatacccgtctggaaaaaatgctgcagagtgccatgaacaaggtactgaaggaccggaccagtttcgtcatcgcccaccgtctgtccaccattaaaaacgcagatttaattctcgttctcagggatggggatattgcggaaatggggaaccatgagagcctgatggcgcatagcggtttctacagccagctttacaattcccagtttgcgtggggatcggaggaagcgtaaaaacagtgtttgctaaaagcagtgtcaaaatttaatttttgatgctgctttttatgttatatttccggaaatgccgggtacttctcccgtaaatattgtgttatgataggagtgaacggttaaaaaggggaggaacacaatgaaacaggagaaggaatttgacctcattcagatggaggttctgaaaaatcccatatttgatcacgagatgagccgggatccgctgctgctctatgtggtggagggggataccggcatcagttttgagagcaagacggtccggctgaagcgggaatcgattattttgatcaacagcaaccggtcattcagtttgaagaagcggcttggaagctccgaggatcttttgctttgtgtcctgaaaatctccaaggcctttctcgtgacctataccggaaagaaaaatctcctgttctggtgtaattctacagaggagggagagggggaggcctatgagaagctgagggtgatcctgcagcagctgttgattgattatgcaaacaatccgccggaacagtatctgctgcggtacagctgtttttaccggcttcttcatcagctcgtaagctatttcatcatctcggagagcaatcatcttgtaggcggcagcgataaggattctcagagccgtctgaatgatctgattgactatattgagagcaattacgatcagcctgtcagcctggaggagcttgcagagcgtttccatctctccggcagttatgtatccaggtattttaaacagaaaatgggaagaaactttatcgactatctgtatgagacgaggctgtatcacgcagcggagctgcttttaaatacggataaggcgattacggacatagcattggaaagcgggtttccgaatctggcgatatttaaccgccgttttcggggcatgtataactgcacgcccacaaaatatcgggaggcccacaggaagcaggaagacaggacagaggaaataaaggcgaatcagagggagcggatccgtacgcagctgcagagccattttggatattccgcggcttccggtttgctgccggcggagaaggcaaaagcagttgagtcggtggattcctcggtctgcgggccttatcatcggatctggaatcggaccatcaattttggtccgctggtggaactgttgaaaacaggcagccgggaggcggtgatctataccaaaaaagtgcttggaatcaggtatctgcgggtgtggaacatatttgaaaaggagatgtacatagttcagaaccgggagatggggagcgccaggttcaagctgctggatgaggcgcttggcgtgctggtggagaacgatattctgccggtcatcgagattggtgaaaaaccgcgcaggattcttaattcggtcaatgattttctgcgggaatcggaaaatgtgacgttgtttcaggactatcaggaattcctccggtgctttgcggacatgatggagcatgtggtccgcaaatttggggaggaggcggtttcacaatggatcttcgagctgtgggatgacaagcgcgtggaggtatatgcggataagcagccgtatacggtcctgttccgcgacgtgagaaaccttgtcaaacaatattcaccgcagtcggttgtgtcgggagcgggcaactatctggggtggtaccgtacccacacagaagaggagcttcgcaagttcgtggacggcggaatctatccggagcatttgacatttacccattttccatatgcacagggacagatcagtaaggagcgcttttccaaacggaaaacagatgagagtgaattgctgcacagcgtgcaggaactgcacggtatcctgaacatgtatggactgaataacagaccggtcgtgatcagcgaatggaacatgacggtttcttccagaaattatttcaatgacagcctctggaagggatgctatatcttaaaatgcaatttagatcttttggggctggtggatacgctgtgctacagccagctgtcggacagcaccaccgattactatgataatcagaacctcttaaaaggggccatggggctattgaccagtgatcatattgagaagccggcatttatcgccatgcgcatgctaaaggaattaaagcctcttctggtaaaaaagacagaagactatattgtgaccagagatgaaagaggtgagatcaccattgtggcttttcattttatcaggagaaaccatctgtattatatgaaggaagagaatgaaaccacgctgcaggaccattatatctatctggaacatcagcagccgaagaccctgacgatacagctgactcatttagcgcatgagggaagctatcttatgcggcagtatattgtcagccggaagcagggaagtatcatggatgagtggcagaagctggcttatatcgaggatccgtcaaaggatgatattcattacttaaaacagagggcaacgccccatatgacgatggacaagatgaaaacggaaggtcagagccttgtgatcagcatggaaatggaaccgcttgagatgcgatgcatcatattgcgtccggaataggcagcataaaataaaatgacaaaatcggtatgtatcgattttgtcattttttgtttgtcggagagagataaaaaagggagtgcaaaaatgaataggaaaaacaggcgaaatgaaaatattgaaaaagaggaatttgaattatcatgaatatatcagttgaggtgctgaaaaaagcgaaaggaaggaagagaaatgaagaaagtgagaatcggtataattgggtgtggtggaattgcgaaacagaagcattttccggcactctcgtcatatccggagttgtgtgagatggttgctttttgcgatatcgttgaggagagggcaaaagaggcctgcgagaagtatggggcaccgggggcaaaggtgtatacagattacaaggagttgttagccgatgagagcatcgacacggttcacgtgctgactccgaacgtcgttcacagtccgatcacggtagcggcctttgaggccggaaagaacgttatgtgtgagaagcccatggcgcacaccaccgaagcggcagaggccatgatggctgcatggaaaaagagcggaaagaagtttaccatcggctatcagaaccggttccgcaaggacagccaggtgctgcatgccgcatgcgaggcaggggatctgggcgagatctattttgcaaaggcacatgcgattcgcagaagagccgtcccgacctggggcgtgttcccgaacaaggcgcttcagggaggcggacctttgatcgacatcggaacacatgcgctggatattaccttatggtgtatggataattacgacattgaatcggtaacaggctccgtgtttgagaagcttggtcattcagagctggccgtacaggacaaccagttcggactctgggacccgaagacctttgaagtggaggattcggcattcggatatatcaagctgaaggatggagcggcgattttcctggagtctgcctgggcgatcaatatgtcgaagagccgggaagccgcgtgcacgctctgcggtacgaaggccggagcgcagcagctgggaagtatgagcatggaaggcggatacgacctggaattcaatcagacaacccatggaaagctgacagagacacggttctcagaggggggaactatcgcgttttttgagggggagaaaaccgatccggaatttctggaggcgaaacagtggttagaggcaattgtggaagataaagagccgctggtaagaccggagcaggcatttgtagttacgaaggttcttgacaatatctataagagcgcggcaactggaaaaaccatttattttgattaggagaagataaaattatggggaaaattttaaaaaaagctatggcagtgggattgatcggctgcatttcgttttcgctggccgcatgcggcggcagcacaacaggcgccagggcacagggggacaaagaaaactccggaaaccaggaggcggcgtccacagagcaggcggcagcggaacagaccgatggagcaggggcaagcggtattaaaattggttataactattttggaaccggcggatattcgctggctgcactggccaatcagtcgcagatcgttttagacgcctgcaaagatgagagcacgtcggcggatgaccagttcagcgttgagaacataatcacagatgtcgagaatatgatcgcctccggatgcgatggaatcattatctggcttcccgcagaaccgctctatacggtggttgcagatatgtgtgaagaggccggcgtctattttgtgctgaatgacaaagtgccaagtgatcctgcgatcaaggagaagctgttatcatatgaacatttcgcaggagccgtggcaccggcaaacagcgtatatggcgaaatgctggcacagtacgcgatcgatcagggctataaaacctgtatcgcaacctcttccgcagagggggatgcttctgaccagcccagactggatgcctttaaagaaaagtttatagcagagggcggcacgattctggcagaggtccattccgacacaacagcagacagtcttccgaacatgcaggacgcactgatcgcaaatgaagaaccggatgtgatttatggagtgggatcggattacgcaatttcggcctgtaccgcattggaaggatatccaaattacaagacgaaggtcatcacctccggccttgacaaagaggcgctgggactgcttatggatgagacggttcctctggagatgatcaacggtgattactggattgcaggctgtttctccgctatcgtccttcaaaatgcatgtgccggcaataaactgacagatgcgaatggcaatgcgatttgggtcgacacaatcgaaccgttcgaagtaagtgcagagacgtatgatttgtacgagaagtactttatggatcagtccgtgtacaccgaggaagagattcaggccatggtggggatctcctgcgatgagatgctgtccatcataaacgactacagccttgacagcagattgatggcaaagtacgaagcgggaatcatcccggcagatgagatgaaagcagcaggttatgatgtgcagtaaaaattgcgggtgagacagaaaagagggcagccgttaaaagaagtggctgccttcccgtaaaaatggaggaaattgacatgacaaaaagaacaaattctcaactgtgcctgctgggaggtctcctgattcttatgatcctgtgcaatgtgattgtcggcggaaaattgctgtctgtgaacaatcttctgacgattctgtctcatgccgtgtttcccgtcctggcttcctatggattgatgtttatcttctccggcggtctgattgacctctcggtgggagcgaacatcctgctgagcgccaacgtgggtgctttgctgggagagcagttaggactgggatatccgggcctggtgatcggagcagtcttatgcgcagtattggcagagcagctgtgtgtacagtgttccatatctctgcacattcccgcatggatatccggtctgggcagtgcgctgattctggaagcgattctggcgcagtggtctaccgtggctgcatctagatcagaaaaacttccaggcgtaagagcgatccgggcgttgggacagatgccgggaatgctgatcctgctgattatcgcctttgtggccgcctatattatttttaacaggaccacactggggatcaatctgcaggccatgggaggaaattcacaggttgcgcaggtgatgggaatcaaggcgaaaaagacgctgataggagctacggttgtgggcggcatatttgtggggcttgctgcggtgaaccatatcagctttgcaggcaaactggactgcagctccggtttaaacagtctgaatatcatctttaaatccctggcggcgacgctgttagcggattctatccagaacatcgttacgaagccggtggggattctgatctccggtatctcggtggtggccctgtttaatatcctgaccttgtttggggttccgtccggtacgtaccagaacatcgcgctgggaattgtcgtgatcctgtgcggcatcctgtcgcatctgaatgataagggggtggtgaagtaatggcagaagaattattgagaatcgaacacttacataaaagctttggcattacgcatgcgaacaacgatatctgtatgacggtgcggcgcggagagatccgttcgctgtccggcgagaacgggtcgggcaaatcgaccctgacgagtatcatcagcggcatgcagccctttgatgagggagcgatgtttctgcggggagagagctacaggccggacagtcccctcgcggcgaataaggcgaaggtggccatggtagtgcaggaacttggcgtcatcacccctttgacaggcgcgatgaatatctacctgggcaaaacggaacgcttccaaaaagccggaatcgtccatgtgaaggcgatggaaaaggccgcgttggagatattcaaaaaatggaatctggtggaagttccgctccatattccctgcgcacatctgacgatggagcagagaaagatggtggagctggccagagcgcttgataccgatccggatcttctgattctcgatgagattacccagtccctctctcaggatacgagacaggtcatttacaggctgaaagaccgctttaaaaaagaaaaccgcgccatgatcatcatctcccatgacctggacgaaacacttctgatcagtgatacggtcacggtgctgagagacggcgtggtggtagatacggtggagcggaagaacattacggaggaaagcttaaaacagatgctggtaggccgtgagataaggaacgattacttccggaccgaccaggaagccaactttaaagaaaacgtggttttgagcgtaaaagacttaagccttgcaaacggacagataaaaaatgtcagctttgaactgcacgagggggagatcctgggcgtctgcggattgtcggatgccggcatccatcctcttggaagcgcggtatttggaatcacagaaagcaaaaggagcggaaaggtcatagatgaaaagacaggcaggagtctgaagaagccgacggatatgctgaactgccgcggcgcttatctttcaaagaaccgtgatgaagagggcctgatgatgagggcgagtattcggaataacctctatctgcccagtgcaaagcagcttgcgggcgcatttggctttacgaaacggacggatatcgtgacgcttaccgacaggatatacagagagtttgacgtgaaggcaaagagcccgagacagccgatcggacgtctgtccggtggaaataagcagaaaatcaatctgggacgctggctttccaaggacttgaattacgtgatcctcgactgtcccaccagaggcgtggatatcggagtcaaggcgtatatttaccatctgctccgggaaaaaaaggcgcagggcacagcggtacttttaatcacggatgagctgtcggaggccatcggcatggcggaccggattcttgtgatgaacaacggaagaacggcgggcatgctggaacgcccggagttcagcgaaagtaagatcatcgaggtgatgctatgatgaagaagataaaattagaaaaagtagaatcagcgcttccgatccttattttcgtatttctgctcctgatttttatgattaccacaggaggtgcgatctttgacgggagcaacatgctggtcatcgtaaaacagacccttaatacaatcatcgcggctctgggaatgctgttcgttgcagcgctgggagctaccgatatcacgcaggggtctctggtaggctttgcaggcgcggtgggcacagttgttgcaatcaattacggctttgtaccggccatcgcagcagttgttgcagcgggactctgctccggtctgttccttggagtggtcaatgcaagatttaaggtaccgtcctttatggcctccctggccatgctgattgccctccgggcgctgggaacggtggccatgggaggcagcacctccggtctcacggtaccggattttgtgaaatccctggacagcaataccatcaagctgccggtggtgatcattctggtggccattgtgagctatgtatttaataaaactccattcggagcctactgcagggcaatcggtgagaatgaaaatgccgtcagattttccggcatcaacgtgaccttcatcaagatcgccgcctttggtctctccggtctgtttacgggaatcgcggccatgtttgtgctggcgcgcgtaggcggctgttccaccaccctggggctgggctttgagatgcgcgtcatgatggccatgtttatcggcggtgttccggtagagggaggcgacggcacaaggctttataagatcattatcggtgcttttaccatcgcccttttggagaatggccttgtgcttaccgggtcttcgggagccattacccagctgatccgcgggatcgtgcttcttgcggcggtttacttgacgattacggccaaggcaaagatacagaaagtggatggagagacagcataatacagattcagaaaagtgagggaacgtatggcatttgcaatgagagtgaatttcgtagacgtggtctgcggcaattcgttaaaaaacgatagagtgaacgggaaaaaaagtggtttttcctttgatatcaggctgagctattacagaggacatttcctctccgatatcgatgaattcgaggttaaggtggatggagcggcatacaggcaggaggacgtgtacttctgcatcaatgggaaagaactgaactctttggagctcggggaggcatataccgaattctggaatatcctggagccggcccatatcaaagtgattcttccgggcggcctttcagcaggcccccacaaggtggaggtaaaactaatgcttcgcgtgccgtatcttccgctcccgggggcggaccatgaccatgcctacatgccgttaaactcctgcggcgaaaaagtgctggagatcagagagggggaaaacatcaatggctgatataaaactgggacttaccctatattgctttactccggaatacgtgaaaggagtgctggaccttgagggcataatccggactgccgcggagatgggatatacgggatatgagatcgtagcgacgcagatgtgtcccgattatccctatgtgagcgaccgttttttgggagagcttacagcgatgaacaggtattacgggatggagatcgtaagctatgccgccaacatggacagaggcttaaggcacgaccggaatcttacagaggatgagatgctcgcaagggcaattgtagatttaaagtcggccaacaagctgggagccacggtgatgcgggagcagtatctctgtgggcccaatgtgctgaagcgcctggcgccctatgcagagctgtacaacgtgaaggtgggcattgaaattcataatccggagtatccgacctcgccttatatgcaggagtatctgcgggttatccaggagtcaaagagcagctatataggatttattccggacttcggctgctttgctgtaaagccgaataagccgaattgggatgcggctcttcgaaacggggcaaggctttccatgcttgatttggcggcgaagctgcggtttgatgaggtacccatggaggaggcgcagaaaaaaatggctgccgccggtgcgaatggtgcggaaatgggggccttcagcggtatgtacggttttgttactttttacagcaagccggatactcagggattaaaaaagatcatgccctactgtgtggaaatgcatgggaaattccactatatatacgaggacctgcatgaacacagcataccctatgaggatattcttcctgcgattgcggcttcggattttgacggatacattatgacagagtacgaggatcacgatccggtatccggagatacctttacgcagatggcgagacacattgcaatggaaaagaaaatattaggtttgagagagggagtcagaagatgagcgatatcattaatcttggaattattggacatggattcatggggcatgagcatgaggcgatgctgtccgattttgaaggaatcagagtgacggccgtctgtgacacggccgcagaccagctggaagatgtaaaggggggaatcctccggtacggcacgccggaagaactgctggccaaccctgatatccaggtagtaatcattgcggtcaataacaaccagcatagaaagctggtagaactggctgccagggcgggtaaggatattatctgcgaaaagccggtggccatgagcgtgaaagagcttgatgagatggtaaaaatcgtggaggaatgcggtgtgaaattcaccgtgcaccagcagcgaagatatgacccggactaccgcactataaaggagatctacgaccggaagagcctgggggacgtctatacgattaagaaccagctttacggatttaacggaaatatgcatgactggcatgtatacgtatcagagggcggcgggatgctgtttgactggggcgtgcacctgattgaccaggtcatgtggatgatgccggaggcaaaaatcaattcggtgtttgcagatgtcagaaatgttatcaattttgaggttgacgattattttaatatcatgctgaagttcgacaacggcgtaacggcaaacattgagcttggaacctactatttaaaggatgcgccatccaactggttcgagcgccattggtttatgggcggaaatgagggaacggcgtatgtggatggatttcatccggaaggcaggatcgtgcgcacggaggagctgcttcacaacgtatccgggaaccggacgatgaccgctgccggacccaccagatcctttggaaatccaagagaagggctgattgttacggaaccgcttccgacggtcaataccagtcacagaaattattttgaaaactatgtcagagcctatcatggccaggaagagtttctcgtaaagattccggaggtgcgcagagtgcttgcggttatggaagccatttgggagtccgcaaagacagggaatgcagttgcatttgaaaaataggaaagagaaggagcaattaatcatgagcagaatcaagacgtgtgtcagcttgtacagcttacagaatgaatacatgacaaagaacatgagtctggaagatatcttccgtttcatgcaggaaaattccgtggatggggtggagattttgccggaccagatgatgcacggcacaccgcatccatctgaggagacgcttgcagaatgggacagactttgcaggggctacgggataaaaccggtgattgcggatgtgtttttaaacacaaacctctatgataaccggacactgaccaaaaaagaatgtgtcagtcttttgattgaagaaataaagctggcacaccggcttggcatgaacatgatccgtctggtatccatgacgccggcttttgtgctggaaccgctgcttccgtactgtgagaaatatgatatgaagatggcgctggaaatccacgcggggctcagctttgacaagcagaagaccaaagactatattgccgagatgaagcgcctgcattctccgtatatcggtctggtgatcgataccggaatcttctgtaagagagaacccagagtgatggagaactactgcagagcgcttggaaccggggaggagccgatcgccgtggttcagaagctgtacgaacagggcggggacggcaggtcgatctatggtgaagacggggagtttattccggcgcttgcagctgtcttaaaatccggagcagatcatatgtatgcacattttgcggatggctatgagaatgaaccgctttcggtgctggatgacctgatgccatacattttccatattcatttcaagctgttcgaaatgacagaaaacggtgaatattcagtggattatcaggagatccttaagtaccttcatgatcatgactatgacggctatgtggcgacggagtatgagggcaaccgctggacgattccggggcagccgatggcggagaaggaacaggtcattgcacatcagaaatatatcagggattgtctgaaagaaattcagggataggaggaacgggaaatgtttgataacaatgtatttacggaaggaacctgcaaaaaatttgaagaggcgggaaataccatgggttatgagctgcagacccacattacctattacagaggcattcctctttctatggtaaatgatattcaagttgcggtcgacggcgcggcggcggcccgggaggatatccgctgcagcgtggacggaggcgagtactggttcacactggatgagatgaagacggtggtggaacataaatgggagtatggagaaccgatgactgtccgcgtgatgcgtgctggcggactctccagaggcactcatgaggtagcgctcaccgtgattgtacgcaccgcttatattccggttccgctggaaggtaataagacccggactgtgatgattgcataggaggagaaatatgaaaaagagaccagttacattagcatccgggcagttcggagacatgagtctggaggaactctgccagatgtgccggagaatcgggtatgaaggaatcgaactcgcagcccatgcacattttgatgtgggaaaggcgctggaggagccgggttacgttccttgggtaaaggaaacgctggaaaaatacgggttaaagtgctacgcgatatcagcccatcttacaggacagtgtgtgggggatgtgtgggatccccgcctggatcattttgcgccatcggaaatttcaggacagccggaaaaaatcagagcgtgggctatagcggagatgaaacgcaccgtgaaggcggcctcgatgatgggggtaaaagtgataaccgggtttacgggatcccctatatgggcctggtggtattcttatccgcagacgacccgggagatgatcgatgacggctatcagctgatctatgatctgtggacaccgatctttgatgtgttcgatgaatacggcattcaatttgcgctggaggtacatccgacggagatcgcatacgattactattccacggaggcgctgcttaagaagtttaattacaggccaaccctcggtatcaactttgatccgagccatctcgtgtggcagggagtgaatgaactgacttttgtaagagattttgcagaccggatctatcacgtacatgcaaaagacgtcaagattaaccgcaatgaaaaggcggggattctcggttcccacatagagttcggtgataccagacgcggctggaatttcgtgtcggtgggtcagggcgacgtggacttcgacggaatcatccgggaactgaatcaggcgggatatgagggcccgatttcggtagaatgggaagattccggtatggaaagggagttcggcgctgctttagcataccggtatatcgatcagatgaatttccagccatcggaggtcgcgtttgacgcggcgttgaaaaatgactgatggagatgtgaggagattcctatgaataactatctatttggcattgatattggcggaactacagtaaaatgcggtttattcggacttggcggcagcttggtggacaaatgggagatcatgacagatacccgggaaagctttaatgtttcaatcattatatgatcaaaataaaaagatagcatagattcagaaatgacactaaatatcgctcaaaccgatgtctgatggcttgagccgtatttagtgtcattttttgtgcagggagaatagaaaaatgcctaagacaagatttcaaacagcagtatttacattggttacagcgtggctgatggtctatggaatgacgctttacaatacggtgcttggaaccggagaattcacaaattcaacatttctgcatgccctgacggggatgtgggtggagtttgttatcattttcctctgcgcctgttttatagcgggaaatgtagcgaaatatcttgcatttcgagtggtacagccaggtgaccggccgatatttattatatttgcaattcagattttcacggtcattgcgcaggtcttttttgcaagtattatggcgacggtcaagatacacggctttacaaatctgtttttgccgcaattcatgactgcctattgcaaaaattttataatggcgctgcccttgcagctgatcatagccggaccgcttgcaaggctattattcagaagcatcttcttgagaaaagagaagggatgacgaaggccggcttcttccggtggctttgtatgaggatcgcaaaacttgttcactcactccctgccaatctccgcttcatcaaccaacggaagcatcacagaaaacgaacttccaaagccctcgtcgctgtggacctccagcttgccctgatgaagcttcacgatcttgttgacgacggtcagcccgagtccgtttccctctgtagtatgggaggagtcgccctgataaaagcggtcgaagatatggtctgtctcctcctgactcatgccgcagccgttatccataatgcggaacacgatgtgatcctcctgtttatggagcttaaggacaatcttcccctttggggacgaaaacttcactgcgttgtcgatcagattgatccagacctggttcagtaaatcccggtttccgtagtactccagttcatcaatgtcaaatatcagctccagctccttcgccagccatttattctccagcagcagcacggacagccggatttcctctgataaatgaaaggtttccatatcggtaaggatgctgagattttctatttttgagagattgagcacgttggcggccagctgggagaggcggccggactcgtggatgatgacatctaaatattccttccgttcactttccgataagtcccggttcttcagcaactttgcaaatccgcacatggacacgatcggcgtcttgaactcatgggagaaattattgatgaaatccgatcgcagcagttccgtgttttccagctcctgagccattcggttaaagctgtcggaaagcttgagaaaatcgtcagtcagatccagatggatgcggacgtgaaaatctccgccggccagctggttaaccgcctggatcagctggttgataggctttaaggtgatgcggtttaccagagtggccagaacggttccggtgatggcgctggatacgattaaaagcgggatcggacgccagaactgcgggattggcgcctcgatctgatagcggaccttcatataaaaatacatgataagcccttgaaccgtcatgataaacagcataatggcaaaaatggagagcgtgaaaatcagggtgatggttttcgtgggcttcctgttctgttttttcttttctttcttattcatattcatatgtgtttcaccgccttgtagccgaggccgcgtatggtctcgatggagaactccggatacgtctcaaaacgcctgcgcagccggttgatatgggtgttgatggtgctgtcgtcggattcggattcgattccccacacttcattcatcagctgcatcctggtgaaaatcttacccggataggacagaagcttgtaaatcagacagaattccttacatggcagctcctgtacttcctctccgcgggagactgtcatggaatcgtagtccaataccacatcgccaattcgtatctttctctcgctgacaatctgggcgcggcgcaggagcgccttgattcgaagaaccatctcctcctcatccaccggcttcgtcatatagtcatcggttcccacgataaatcccctgtgtttgtcttcggggagctgttttgctgtcaccatcaggattggaagggagtaattggactctctcagtcgtttcgtcagttcataaccgtccatacccggcatcatgatgtccaaaagaacgagatcgatgtgatgattgtccaacaggtttaaggcctccatcccattaccggccggaatgggataaaagccgttttctttcaggacggcggtcatcagttttctcgtattcgtatcatcctctacaaccagtatctgaaacattctattatcctccttgtataaaagggtattgtaagctttttaaatattgtaccataattatctaaagcgaagatgaacaaaacccgaatatcaaaccatttttcacagaagtttcacaaatggacggccctgactgccgccattgtttatactgaatttatgttcatcccttatgataaaaaccaatgaaaaaacaaaaaaggagatgcagcatgaataaaagcagaaaaataataatcggcgcggctgccggtattgcagtggtaatcgctgtcgccctggcggtgtcccgaacgggacagaaaccggccggtaatatgggaatggcacaggagagcctggtgacggtggtaaaggcagatacgccgcagactggagagatcaagtcgaccacgtcgcttacgggcacggtggaaccggcagatgtggtacacgtctatgccaaggcctccggcgatgtcacggcggtgctggtaaaggccggcgacgtggtgagccaggggcaggtcctgtttgagatcgatacggagcaggtggattcggcaaagaattccatggaatcggcggccatcagcctgtcagaggctcagagcaatttaagcaggatgcagcttttatacagcacaggggatttgtccgaccaggaatatgagcagtacagcaatgccgtaaaatcagcaaagctccagtatgaatcagcgaaaatgaactatgaaaaacaggtggagtacagcacggtaaaggccgctatcggcggaaaggttgaggactgcggcatcgaggtctatgaccggatcacccagtcccaggagctctgcgtgatctcaggagaaggggaaagccgtatttccttctatgtcacccagcgcatgatgaagaatctgagcgtgggagaccagatggagattcagaaaaatggagtgacctacgaggcgtatatcagcgagatcagttcgatggtggattcggataccggactgtttaaagtaaaggcgcagatggaggacaccggggagattgcggcgggaagcaccgtgaaactcagtctggtgacagagcatgtggaaaacagtatgctggtgcccattgacgccatttattacagcaatggtaatgcttacgtttatctctaccaggatggaacagccgccaaggcggaggtggaagtgggacttgaggattcggaacatgcgcagatcgtttccggactttccggtgatgaactcgtcatcagtacctggagctccaatctttatgaaggagccaagattcgtttgaaggaagataccgaggaaacacagacaggacaggaggcatagcggatgggacttaccagatttgtattaaaacggccggttgcaacggtcatggcgctgctctgtctgctggtatttggcatatcctctgtattcagcgccaccctggagcagatgccggacacagaccagccgatgttaattgtttcggcatcctactccggagccggtcctgaggatgtcgatgagctggtcacccagccgattgaagacaaggtcagtacgctggagggagttaagagtatgagctcgtcatccagcgaaggccggtccatggttatgctggagtacgattatggcacagatatggatgaggcttacagcgatctgacccagagcctggatgggctggaccgccagcttccagacgacgtggaaacctccgtgatggagatgaacaataatgctggaagcacgatgatgttgtctatatccaatccggccaaagaggatttatacgattatgtggaccagacagtggtgccgctgctggaacagatcagctccgtgacggacgtggaggcgatgggcggaagctccgagtattaccgcatcgagcttcagtcggatgagatggcccagtacggcctgacgatgagcgatatcaccagtgcgatgagctccgcaaacctgtcctatccatccggagacgcggtttccggaaacctggagttttccgtgtccacatccctggaaaatgataccatagaggcgctgatgcaggttccgattacgactgcgggcggggaactcgtctatcttgaggacgtctccagggtgtatgaagcggaagagagccgaggcggaatatcccgttacaatggggaggataccatttccatttccatcaccaagcagcagagcagcaccgccatggaagtctcctccgcggttaaggaggtgattgaaaagctggaggctgacgatgaaaacctgtctatccggattgcccaggacacggcggacagcattaccagctcgctgaaagacgtggcggtgacactggttctggcggttctgatttccatggtcattattttcattttctttggagattacaaagcgtctctgattgtaggaagctcaattcccacctccattctgatgtcgctgattctcctgaccagttttggatactcgttaaatattatcacgatgagcggtctggttctcggcgtcggaatgatggttgacaactccatcgtggtgctggaaagctgtttccgggccatggacagccaggacgataaaggactgctgggatacgcgaaagcgtcactgactggaacgggtctggttattcagtccattatcggttccacggtcaccacctgtgtggtatttatcccgctcgtatttttacagggaatgtcagggcagatgtttggagccatgggatatgtgatcgtattctgtatgtcctcctcgctgctgtccgcgataaccattgttccgctgtcatacatggtatataaaccgaaggaaatggtgaacgcccccatgtcccgtcccatggaacatatgcagaatttttaccgccggatcatgccgggactgctgaagcacaaggtcctgattatgctgtcctcctttgttctgatcgcggcaaccctgtttctggccagcggaatgcagacagagctgatgactgcggatgacacgggaaccgtcagcgtctccatcgagatgaggcccggccttctgtccgaaaaggcaaatgagatcctgacaaaggcagaagcgattgtgcatgcgcactccgatgtggaatcgtatatgctgcggtataacagcgacagcggtacgatttcggcgtacttatatgatgacaggacgatgagtacggctgaggtggctgaacagtgggaatcggaaatggcggatttagacaactgtaccgtaacggtggaagcatcatcctccatgagctttatgggtggaagccgtgggtatgaggctatcttaaacggcaccgactacgatgagctccaggaagtcagcaataagatcgtagaggaaatgactgccagagacgatgtgataaacgtccattccagtattgagaacacagcccctgtagtgaccattaaagtggattccgtgcttgcggccacagagggacttacggcatcggagattggatctcaggtcaagcagctgaccgacggcgcggaagtgaccacactgaaggtggatggaaaagaagtgagtgtcacggcggaatacccggaggatgagtaccgaacggtcagccagttaaaggatgttattttgaaaaagccggccggcggctacgtagcccttacggatgtcgcggaaatctattacaaagacagcccggcttccatatcaaagacggataaagcgtatgaaatcacgatctcggcggattatgccggcagcaatgtgcagtcgatgatcgacagcgaggtcatcagcccgaatttaagcagcacggtaacgagaggaagcaactccatgaaccgcatgatgcaggaagaattttcctccctctatcaggccattgccattgcggtcttcctggtctttgttattttagcggcgcagtttgaatcgccgaaattctcctttatggtcatgaccacgattccattcagcctgatcggctccttcggcctcttaaagctgaccggtgtcaccatcagcatgacctcgattctgggattcctgatcctgatcggtacggtcgtaaacaatgggatactctatgtggacacggtcaatcagtaccggctgaccatggatcttaagaccgcgctggtagaagcgggggcgacccgtctgcggccgatcctgatgaccagcctgacgacaatcctgtccatgattcctatggcgatggcaatcggcgacagcggttccacgacacaggggcttgccgtggtaaatatcggcggtctggccgtgggtgtggtagtagcacttttcattcttccggtttattacgctctgatgaacggtaaccgaaaacgcgtcgaactggatatataaaaggagggattgaattgatgagagacgggacgaaatacgggaagatacatgggctgaagtacaggacgagatacgggaaagggatcggctgtcttgcactcaccgtgctgtgtctgacggccgcgccgatgcaggctctggcaggaagccctgaattcgcttattcagcggaaacatgggctgccctccgggataataagctggagtacggggagatcgcggacctgatccacgagtacaacaacaccgtgattcagaatcagattgaatacaaggattacaagggaaaaacgcaggatgacatcgcgcaggactactacgacgcggccgatgatgtaaccggaagcttaagctatcccgattcggatgatgaaaactatgccagcggcctgtcgtcctacctaaatggcagacagcaggcggataccctgcgggaaaagggagacgacaatgtggaggacggggagatcaaaaaactgggatacgatcaggaggaggcagagcttgtgaagcaggcgcaggaactgatgatcacttactggaatcaggtctggaccataaagaacctggagcagacgaaggagcaggcgcagaagtcatacgaatccgctgctgcgaaacaggcggcaggaaccgcgactgccgccgtggtacagtcggcaaaggaggctgtggcgtcggcagaagcatcaattctctctgcggagtcttccctcgctaagacgaaggagagtctttgtctgatgctgggctggagctacggcgcggaggtggagatctgcgaactgccggaaacggacctggaagcgatcgcctccattgatctcgatgccgccatccagaacggcctggaggcaaattacgcgctgcaaatccagtcgcggaagacggcgaacgcaaagagcacatcgaaccgcgaaagccttgaggaggagtacaagagccagaaggagacggctgccacaagtataaaaagcacgtaccggaacctgcttcttgcaaagtcggatttcgatcaggcagtccaggcgtataccctggaacaggaaacgcttcagacggcggagcggaagctgcaggccggaaccatcaccagaaatgattatgcaaaacagcagagctcctgcaccgcgtctcagatcagcgtacagacaaagaagctggctctgatgcaggcgcagctggagtatgaatggtccgtaaacggtctggcttctgtttcatagtcatagtggaaaggagagagaggatcatttgccaaatataaaaagtgtatacaattggaacacacacagaaggaaacagtgcagggcggggagaaaaaggtacagagtgggaatccggttcctcgcgtccgcagccctgtgcgcatttctgacaatgccggcggaggcgggggcgaatgaggcctgggcggcagagacggaaaacagtacagtagccgtcaacgttgagtatgacaatctgcgggagctgctgaaggtgggaaaccgcgtgctgaaaaagagcatagatacgtatgaagacaacgtggcggcttacgaggaaatctggtcagtcatgaaatggaggcagagcgatatggaggacctggcggaggaggccgaggaggcgggatcggagaatctggcgctctatacctcgaatgccgccatgctgaagaattccgcaagtcgtatccggaaacagatcgagagcctgacttcggaaaagagtacgagaagtctggaaaagtcggcggactcctacaccatggcggcccagacacttatgaattcttacaatcagatggttctaaacatagaggcccagtccaagagcgtggaagtttaccaggcgtccagcgacgaaacggagcggaagatggccgccggctccgctacgcaggcggaggcgaaggcggcgggagaccggcttaagcaggcggcgaattcccttgcatccttacaggaacaggcacggcagctgaggacacagctgctcacgatgctggggctggctgacgatgaaaacgtgtccatcggctccatcccggtgccggatctggcagccatcgacgcggttgattttgaggcggataaggcgaaagccatcggcaacagcagcagcgtgcaggacgcccgccacgcttcggctgccagtacagctgccgtaaaccggagattcaatcaggtggatgaggcggagggaaccgcggaagcagactttacagagacgtatcaggagatgatcgtaagcaggacagagtatctggccgcggctcaagcctatgagagcgcacagaatacgtaccggtccctgcaggtgaaaaaacaggccgggcttttgaaacagtcggagtatctgcagggagaggcggaatatctggcggctgaggcagctatggagactgcttccatgaacctggttcaggcgtacgagaactactgctggacggtaaaggggatcacttaagaaaaaatgctctggccaaaaggggttacagccagagcatttttatgttatactggaagcacaaaatttattacagaaaggaatgaggttgttctattgaaaaattccctgctgaaattgagagagaaactgacggaagcgcttaattccgtactcccgatcatcggaatcgttctgattctgtgctttacgatcgctcccatttcctccagtattttactgtgctttctgatgggcgcggccatgatcgtcgtaggcaccatgttcttcacgcttggggcggagatcagtatgactcccatgggagaaaggctgggtacggccattacgaggagtaaaaaactgagtatcatcgttatactgggattcgtactgggattcatcatcacgatttcggaaccggatcttcaggtgctggcggaacaggtgccgtccataccgaaccggactctgatcctgtcggtcgcgctgggcgtcggtgtatttctcgtcatagcacttctgcgtatgctgtttagcattgcgctgtctcacatgctgattgtattttacattctggcatttgttcttacactgtttgttccaaagagctttttggcagtggccttcgattccggcggcgtgacgacgggccccatgacggttccgtttatcatggcttttggtatcggtatttccgccatacgtaatgaccggcatgcgtcggacgacagctttggcctggtggcactctgctccataggcccgattcttgcagtacttatcctcggaatgatttacaggcccaatgaaagcgcctacattccgccggtccttccggagatcagcaattccgtagaactatgggagctgttccgcgtcggacttcctacctatattagagaaattgctgtatcgctttttcccataatcctgtttttcggtattttccagatcgcagttctcaaactttcaaagagaaatttaaggaaaatcattgtcggcctcgtctatacgtacatcggcctcgtgctgtttctgacaggcgccaatgtgggctttatgccggccggtaattaccttggacaggtgatcgcctccctggattacaactggattattgttctgatcggcatgctgatcggattctttatcgtcaaggcggaaccggctgtttacgtattgaacaaacaggtggaagagatcacggacggcgccattccggccagagcgatgagtatcagcctttccatcggcgtggccgtatccatcggaatcgccatgctgcgggtgctgacgggaatctccatcctgtggttcatcatcccgggatatgcgattgcgctggggctttccttctttgtaccgaagatatttacggccatcgcctttgactccggcggggtggcctccggtccgatgaccgccacatttctgctgccgtttgcacagggagcctgtacctcggtgggcggaaacattgtcactgacgccttcggcgtggtcgccatggttgccatgactccgctgatcaccatacagattctgggcatgatctatcagatgcagcagagatccgcaccgaaagaccagacattttccgagccggcactggacttcgaccagcttgacgatgatgcgatcatcgaactttaatggcagcatagctgcaatatagcatcacagataagatttcgaaagaaaggactgcagtatgagcgaactgtatttaatggttacaatcacggaaagaaccgcggtaaaaaagtttcatactctgtacggccatcacggggcggatgttacctttataaccgtgggtaacgggaccgcggtcagcgataccctggactatttagggctggaggagacggagaaggctgtcatgctgtctgtggtgacgggctccgtatggaaagaaataaaatcagatctacagaagcatttgaaaattgacgttcccggcacgggcatagcctttattattccgctcagcagcataggcggcaagaagcccctgctgttcctgacggagaatcagaattttgaaaaaggggaggaaagctcattgaaagacacgaaatatgaactcctgattgtgattgccaaccagggatataccaacatggttatggacgccgcccgggaggtggaggaagtcggaggaaccgtgatccacgccagaggcacgggcttagagcgtgcggagaagtatctcggcgtctccctcgtggcggaaaaggagatggtgttcatcgtcgtaaagagcggcatgaagaaccttgtcatgaaaaacatcatggaaaaagccggcccggcaagcaaggcacgggccgtagcgttctcgctccccgtgacgagcacggcgggcatgcgcctcatggaagaggcaaaggatgataacgattaggcaggagagcgaaagaccatggaaccatactattacagccagatgaacaagacagagcagagcgcatatcacgccatgaaaaccggtctgacggcgctcgccccgtcctttgcggttccgcggctggaaaaccgggaactggcggatatctttttcaagctccgcctggactgtcccgaactgttttacggtaccggattccactaccgtttttaccagaattccggcagcgtggagatgataccggaatacttatttgacaagggaaaggtgaaagaacatcagaaggcgatgagcgccagaacggccaagctggttcgcccggccgaatccatgacagagtgggagaaggaacggtatattcatgattttatctgtaccagcgtccgctacgacaagctgaagaagccgtattcccatgagatcatcggccccatgggccagggcgtgggcgtctgcgaggggatcgccaagacggtgaagattctctgcgacgccctggggatctggtgcatgatagccatatccgaagccaatccggaaaagggcattaaataccgccacgcctggaatattgtgaaaatcggcggccggtattaccatctggatgccacctttgacaacagcctgggccgtggagagaccatccgctacgactactttaacctgggggataagcagctgttccgcgaccacgagccggtgctctatcaggcgccgccatgcagcgacggagaccatttttattacagggaaaagaagctttccttcacaaagacggaggatgtggccaaacgcgccgcacaggcggtcaaaaaaggaaagccgcttattttccactggagaggcggttatctgacacgggacacggtgacagaactcttaaatctgatggaggaagccgcaaggcaaaaagggaagcacgtccgggcggggctcaactggccccaggcggtcttttttgctgaatttaccgaggtattgccggcagaagaactgctggtagagactgcgaatgaaggggaagtactctaataataagaattcggcgaagacgcaaagctgtcttgctataatcgggattaaaatatgtatgagagtggaccggaagtcagaaacagatgcattttaggtctgaaactggcttttcaggcacctcttttttattttcttctatataaaagaaaggtaacgtgaccggaggcttataaaaaaatcacagccaggccgaaaaatcttttgatagtaaaattattacaaatatggtaaaatagaacaaccataggttgtcccggatccctgtaaaacaggcagggacaaaaaaggaaggcaggaaaccggactgtgaaggaaaataaatacgatgatgagtcattttttaagaagtacagcgagatggatcgctcgaagcagggcttaaaaggggccggtgagtggtctgagttacagaaagttctccctgaatttagtgggaaacgggtcctggatctgggctgtggttatggctggcactgtctgtatgctgctcagaatggagcgcaatacgtcctgggaacagatatttccgagaaaatgctggctaccgcgaagcagaaaaacaatcatgaggcgattgtataccgctgcagtgccatggaggacctggattttccagctggatcctttgacgttgtgatcagttcactgacgtttcattacgtcagagacttcgagccgcttgtccgaaagataagcagctggctggctccggagggagcattcgtattttctgtggagcacccggtgttcacctcacgcggggatcaggactggtgctatgatgaagagggcaggattcttcatttcccagtggaccgctactattatgaaggtgagcgggatgcagtattccttggcgaacacgtgaccaaataccaccgtacactgaccacatatttgaatacactgctggtcaacggatttacgtttaagaatattatcgaaccccagccgccggaagagatgatggatattccggggatgaaggatgagatgaggcggccaatgatgctgattatagcagcgcagaaaaagtaaaaacagcctgtatcatatctatatatagtacaatcataaagaaatcatataaggaaaccgtacacaggaagaaggggaaacaatgacttcagaggatgaactttttgccgagtttggcgcagatgccggcatgttttacagcgctctggtcagaagcacggataattatatttatattattaacatgaagactgatgtcgcattggtatccccgaatatgcagaaagatttcgagctggaaggaagactggtgccgggactcgtttccgtatgggggaatctgatcaaccccaaagacttcaagcggtattccagatcgatcgaggcgatgctgaacggtgagaccgatgtgcacgatgtggaataccaggtgcttaaccgaaagggagagtatgtctgggtatgctgccgcggagtactgaagagaaatgatgagggcgagcctgttatttttgccggagtggtcacggatctcggcagcaagggcaagattgactatacgacagggctgtttaccaaccgggagtgtgagaaggaagtcggccggatttttgaaaatgaggaaaacgaagaaggcggtatcctgctcctgggactggacgatttcgtgagaatcaatgatttaaacagccacatctttggtgacgccgtgctgcgccagtttgcgcagagcgttcagcagcttctgccctccgaggcagccatgtaccgctttgacggcgatgagttcgccatcgtttatcccggcgcgggcgaagaggaactgcgggcgttgtaccagaagatacacgcatactgcaaccggccccataagatcgacgacagttcgtattttcttacggtgtccgtcggcgtagccataatgggaaaagacggcagcggctatcaggagcttctgacctgcgcgttaagcgctctcgaggtgtccaaacagaatggaaagaatacggtcacgttcttttcccaggatatgatgcacaccagaagacgcgcgctggagctttccagccgtcttcagctcagtgtgatgaacgggatggaatcgtttcaccttgtctatcagccgtttgtgcattcggagacgctgcgggtctctggcgccgaggcactgcttcggtggtcctgcgagtcttacggagtggtttcgccggttgaattcataccgcttttggaagcctgcggcctgattgtgccggtcggaaaatgggttctggaggaggcggtgcgaacctgcaaaaagtggctccgctatcagcctgattttattatgaatgtaaatatttcctatttgcagatgctcgacgagtcgtttatcgatttcgtgagacagattctgaatcaatatgatcttccgcccgcccacatcgtgctggaactgacggagagctgtttcgtcacggatatggaggcgttaaaagaagcctttaagcttctgcggaatttgaatatacagattgccatggacgatttcggaaccggatactcttctctgggcatgctgtcccagtcaccggctgatatcgtgaagatcgaccgcctgtttatcaccgcgatcggggatgaagagaatgaatttaaccggtcatttatcggttcggtcatccagctctgccacagagtggggatttccgtatgtgtggaaggcgtggaacggaagaatgagctggacacggtctgttccctggaggccgactgcattcagggatattacatatcaaaacctttgcttcaggaggactttgaaaagaaattctgggatgtgtgatttatttaacaaaatcaacgagaattctcccagcctctataggtgggagatgaatcgcaaaaacaaactcagcggcagtggcgggtagatttcccccactgacatgaggtcaaaacaatccgggcaaccggataaaatggcagcatagctactatgttattctgggttttgtattctgaactcagaatgtggattgaaataacgaacggtaagaaagagggggccgctggcaggtctcttcttttttttatcggtacaataaaaacttattttacgaagataatggtaaatttggtaaaaactttagaaaattataagaatttattgttgtaaaagattatgagatgccattataatgggggagaatggagcgagatattaatcaggaggaaagagacgtatgaaagacgaattcaaccacgtggaaatagacggtaaagaggcggacgatatccaggtaaagatggatgatgtcgtggccgatgctgaggcctttgcagcggaagagaaaaccgttcagccggagcgcagccggaggggcggggcgaagcctgtaccggtgatggaagatccgatgagcgacgaggattttaatgaagaactgaaagagctcatggaagaagacacttccggcaagaagaaaaaaaagaagaagaaaaacggagaaagaggacgccgtaaaaaatggagcggcaagaaaaaagtcctcgtcggcgtcgccatcgcggtggtggttattttcggagcctccaaggtgatgggcgggggcaaggcgccccagatgatggcatccacattccctctgaccaggggcgaagtggtggagatgctttccgtcagcggtcctgtcgagggaacggacagtgtggaggtggtatccaatttacacgcagagattctggagatcccggtaaaagagggagatcgtgtggaaaaggaccagctgctcgccactctggatgagaaggatgcgaaaaaagaggttgatatcgctcagaatgcctatgaccttgcagttactacatataatgagaaacagatcgaggctgagaacggctatgccaaggcaaagcaggattacgatgccgccaaggccaattacgacagaacaaatgtgctgttccagtcaggaagcgcctcccagctggagctggagacagcttccgacgcactgaataacgcacagcgcgatttaaagacatttacattaaaagacggcagaccggtggccaatgaatcgtattcccttcagattgagaacgcggctttcgaactggaccagaagaaggaactgctggaaaatacgcgtgtgaccagcccgatcgccggtacggtggtccgggtcaactgtaaggtaggccgttttgcggataagaccgatgacgacaagccgatgttcattatcgagaatctggacgttctggagatgaagatcaatgtcagcgagtattccatcggcaaagtccagatcggccagccggtagagatcagcgcagatatcttaaacggcgaggctgtgaagggcgaggtgacagccatttccccgaccggtgaggaaaaaggaaacggttccacggagcgtgtgatcccgacgacggtccgcattattgaccagaatacacggttgattgcaggcattacagcgaaggcaaagatcgaactgcagaaggcggaggatgcgtgggtcgttccggtttccgcgctgcttcagcagccggatggcagcaccgcaatcgtaacgatagaagacaacatcgcccatatgatccctgtgaccaccggagttgagagtgatattcaggtggaagtgatcccggcggaagaagggaaactgaccgagggaatgcagatcgttgagacaccggcggcaaatcttacagacggcatgaccgttgtagctgttccggctgcacagtaaaggaggaagcaatatgtggaaaagggaaaaaaggcttccttcctacatgaccgagaatgtatcggatgacctgatccggctggtggatatggtgaagatatacgacaccggttccatcaaggttctgggcctgaaacgaatcaatctgaccattaagcggggagaatttgtggcgatcatgggacagtccggatccggaaaatccaccctgatgaacattctggggtgtctggaccgcccgaccatgggccattactacctggatggaatcgatacggccgacatgagtcccgacgcgctgtctgcgatccggaacagaaagatcggcttcgtatttcagtcctttaacctgatttcgagaacatcggcactgaagaacgtagaactgcccatgacgtatgcccataaatctaagaaaatgcgggaacagcgcgcgctggagcttctggagcgcgtgggcctgggagagcggtatgaacacatgccgaacgaactctccggcggacagcggcagagagtcgccatcgccagggcgctggccaatgaaccgccgctgattctggcagatgagccgaccggtaacttagacactgcgtcttccgtggagatcatggagctgttttccaaactgcacaaggaaggcgccacggtcgttgtggttacccatgaggaagacatcgccgcattcacggagcggattatccggttccgggatggccaggtggtgagcgataagagaaatgttccgaaggagcttacggaagaggaagcagttaaaatgaagaaagaagggacgccatgctgctagaaaatatgaccatggcgctccacgccatccggtctaacaagatgcgctctttccttaccatgctgggaatcatcatcggtatcgcgtcggtgatcgccatcgtttccgtcggtgacagcatgcggtccctctacgcggatgcctataaaaacataggtgtgaaccgggcgatcgtgatggtatcctggcgtgtcgatgattttcgaatgagcgattacttcaccctggacgaactggaccgggcgaaggaagtgtttcatgacaagatctcttatatggacagcgacgcctatgccagtaccgaggcagtttatggaagaaacaaggtaaaatacgagttccaggggattgattacaattatacgaaggtgcagcccacgaacattatttacggccgtgaattgagcgaggccgatgtaagagggcgcaggaataacgtcgtgctggaagacaagggtgcggagcagctgttcgggacagccaactgtgtcggcaaaacgttccgcatgacaatcaataaaaccaccgaggaatatacggtggtaggtgtctaccgcaaggatttgtcgcctctggaggcgatgatgatggggaacggccagacacagtcgggctttatgccttatacgattctcacccgccccagcgattattttcaggatttgaacttctatgtgaaggacggcgtggacatgaagacatttctgcctgagattgcccgctacgttgcaaagataaaaggaaggccggtaacggatatcatgacccagtctgtcgtggaacagatgggaagtgtggacagcgtgctcggcggaatgtctgccgcggtaggcggcattgcagcgatttccctgctggtaggcggtatcggtatcatgaatatcatgatggtatccgtgacggagcgtacccgggagatcggaatcaggaaggctctgggggcccgtaccggcgatatcatgatgcagtttttgacagagtcggcgctcatgtcggcctgcggaggcgtgattggaattctgctgggagtggggattgtcatgatcggcggaagcgccatggggatggtccctgttgtgaaggtgtccgtaatcattgtggcggtcggattttccgccctggttggaatcttctttggcctgtatccggcatccaaggcggcaaaggccgatcctatcgatgcgctgcgctatgaatagggaagggagagaccatcatgctgcttgaaaatatgtttatggcactgcatgccatcaaagcgaataagatgcgttcctttctcaccatgctgggaattatcatcgggatcggctcggtgattgcgatcgtgtccatcggtgataccatgcgttccatggtggccgatttatatgccaatgtgggtatgacgcgggcgatcatctatatctggccatccgacggcggagatatgcgggacagcgattactttaatttagagcaaatggaacggattaaagaagtatttcatgacgatattgagtatatggataccaacgcctactacagcagtgaagcgctgtttggccggaaaaaagtgaaattccagttccagggtatcgattacaattatcctgacgtacagaagatcaacattttatacggacggaatttaaatgaggctgatatcaaggggcgcaaaaagaatgtggttctggaagtgcagggcgcgctggagctcttcggaacggaaaatgctgttggcaagacgctgcggaccacggtctacggcgagacagacgattataatgtagtcggagtctataaaaaagagatgacgccgttcgaagcgatgatgatgtccatgatgccggggcagacgaaggagggatttatcccgtacacgatcctttcgtggcctaacgattatctgtaccagctgaacttttatgcgaaggaggggacggatatgaacgaactgtccgggcgtatggtcccttatcttgcaaggcttaaggaccggcagccggcggatgtgacattttattctgcactcgacgagatgaaggggaacgacagcatgatgagcagcctgtccgccgctgtaggcgggatagcggccatttctctgctggtcggaggaatcggaatcatgaatatcatgctggtgtccgtaacggaaagaaccagagaaatcggaatcagaaaggcccttggggcgaagacgcgggatgttatgatacagtttttgacggaatccgcgattctgtccgcattgggaggcattctcggcgtggtgatcggcgcggggctggtcatgggcggcggcgcgatgttcgggatttccgtggtagtgaagccccaggtcgtcgtcgtggcggttggattttccgctctggtcggcctgttctttggcctgtatccggcgtcaaaggcggcgaaaaaagacccgatcgacgcgctgcggtacgaataaaagatttcggaatcatgaagaaatatgtgtatgtggccggggattttcctgtattttacaggggtatccccggttttgaactttacaaaattataaaaatctccagatgggtctcgccaagtaaaaagttctatgctataataagatgatatgttatggtgtattgaggagagcctatgctgagtgaagaaaaaatcaaaatcatgacgaacctcgccatgttcgagaaaaaagaggggaacaggatatttcccgtaaaccggtattttaaaagtgattatatcagcagcaaactgctgcgttcctttttcagttataccctgagtttccttttgggcattgtcttgtgggtgctctgcgatattgagaagtggctgaatgtcatgtggatcgagagtctcattgaactgggaatgaaggtgggagtgatctatctggccggactggtggtctacctcatcataagcctgtgcatttatgcgaggcgatacgattacgcaagccgcgggatgaaggtctatatggcaaaactgaagaggctggacaaacggtatgaaggtaattccagacccggaacgcggactaaaggaggacggacccaatgatgagtcttcttgttttcaaggaacgattaaaggaattttatgcaaagtttgacatttatatcacgccggtaatcaagtttgtatacagttaccttgcgttctggctgatgaaccggaatatcggtttcatggcaaaactcacgaatccgctcgttcctctggtgctggcgctggcgtgctcgtttctgccatacagcgcgatcagctttctggctgcggcgtttatgctggcccacttatgggcggtatcctttgaggttacactggttatggcggtgtttgtcctggtggttgcacttttatactacggtttccatcccggtgacagctgtcttctgatcctcacaccgatctttttcgtactgaagattccgtacgcgattccactgatcgtcggcctttcaggcggcatgatttccgtgattccggtgggctgcggcatttttatctattatacgcttctgtatgtcaaacagaacgcgggggttctgaccaatgagatatcagccgatatgatgcagcgcttttcccagatcgtgaagagcctcttcggcaataagctgatgttagtgctgattgcggcttttgcggctgcgatcattgtagtgttcattcttaagaatatgtctttcgactactcctggatcatcgctattgtggcgggaaccatcgcccagctggtggtgatttttatcggagatattaccatggatgtatcagttccggtaagtgagctcattataggagtggtggtttctttaatcctgtcggggatttatacgtttttcgtcttcgcagtggattattcgcggaccgaatacgttcagtttgaggatgacgattattattattacgtgaaggcggtgccgaagatgacggtgagcacgcccgacgtaaaggttcaaaaaataaatgccagaaaactccagagaccacagcgttaggcgaaactggaaaaagggaggtggactttcgtggcagatattatagatggattatattcctgggtttccttcttaccaaggataaccaagacgaatctcgttgagattattatcatagcgatactgctttatgagctgcttgtctggattatgaatacgagagcctggactctcttaaaaggaattctgttaatactgtttttctatgtgctgacctatatcttccgtcttgataatatcaagtggattttaaatacgatagcgacgccggcggtgacgatggcgatcgtgatcttccagccggagcttcgaaaggcgctggaacagctgggaagcagaaacccgcttacaggaattcttacctttgatgacggaaaggacaattccgcatttaccgaccggacgatcaacgagctggtgaaagctactttcgagatggccaaggtgaagacgggagcgctcatggtgattgagcgcggcgactccttaaaggagatcgaacgaaccggcattgaaataaacggtctggtgtcaagccagcttctgattaatatattcgaacacaacacaccactccacgatggggcggtggtcatacacggtaaccgggtggcggctgcgacatgctacttaccgctgtccgacaacatgtccatcagcaaggaactgggaacgaggcaccgtgccgcggtcggcgtcagcgaggtaacagacagtctgaccatcgtggtgtctgaggagacggggcgtgtctctgtcgcttcggaaggcggcttaaagcgcgcggttgacgcggatgcgctgcgggaactgcttatggatatcaaacacgtggaaggagaaggcagcagatttaagatattgaagggaaggcggaaaaatgaaggaaaagttgctaaataatctcggcctgaaagtcgtttctctcgttcttgcctttgttatctggatggcgattgttaatatttccaatcccgttgtttccggacagccatttacaattccggtggatgtccgtaatgaggaaatcctggataatgccaatctgacgtatgaaattatcggcaaggacagcgttacggtgagttaccaggtaaacacgagaaacagctcgctgtttcgggaatccgatttcagcgcgtatattgatttaaaggactataacgatgtgacaggcgcggtgccggtcaccatagaggtcaacaaaaacaaggtatccctgatcagaaacggggaagtgacggcgaagccaatggttctccatgtgaaaacggaagccatgcagaataagaagttcgacttaaaggtgaattacgtaggagaggtggaagacggttacgcgtcaggaattactactctgtcctccgattacgtggtggcgcgcgcgccggaatccgtgattggcaagattgcgtcgatcggcattgagattaaccgggaaggtgccaatgcggacttagacggctacgtaacgcccaaatgctatgacgcgaacgataaagaactgacggatctcggagacgaactgacgattactccggaaagcatccattataacatggcgatcctgaaggccaaggaactgacactgaatttcgaagtgaagggaaccgtggcccccggctaccggttcacaggagtggagagcgacttgaaatccgttcccgtggttgcgacgaagtcagtgctggcgtctgtcaatgcgctatctgttgtcgatgacaagcttaccatcgacggagcgactacagacaaggtgatccatcttgatctgaacgattatctgcctccgagcacgacgatcgcaccgaatgcccagagccaggtgacggttaccttaaaggtagaaccactgacgacaaaatcttacactcttaagctggccgatttagccagcagtggttcagaccctgattatgagtataccttcagcaaggacagcgtagatgtgacggtcagggggctgaaggaagatttggatacactggatatcagggatatgaatgccgcgctcgatatgaccggcctggagcctggaacccatgcaggtaagcttaccttcgaggtgggagaagggtttgaagtggtgaattattctgactttgaagtgacggttgtctctgataacgaggatgagagtgaaggccctggacagacgacagctgaccaggagacggatgaaccagcaaccgccggtacttcaaaaaaagcagcagaataagaatcagtaacgatgtgtggagggatagaatatggtcagtgctaaagttgtcataaagaatcctaccggcctgcatttacggccggcggggattctttgtaaggaagctatgaacttcaagtcttcggtgaattttcgttttaagaataccaccgccaatgcaaagagcgtgctcagtgtattgggcgcctgcgtaaaaagcggcgatgagattgaattcgtctgtgagggagtggacgaaaaagaggctctggctgccatggttcaggctgtcgaagacggactgggcgaataaatctattttataattaataaggaggtcttgttatgatgaaaggaacaagcgcatctgcaggtatcggcattgggaaagccgctatcgtggaagagacagaactggtgattaagaaggagacgatctccgatgcagcagctgagaaggaacgttttcatgcggccctaaatcaggcgatggaggagacggatgctctggctaaggatctggctacgagagtgggagagaaggaggccgagattttaaacggccatttaatgcttctttctgatccgatgctgacaggcgagattgagaacacgatcgcaggggagaatgcgtgcagtgaatatgcgatcgagaatgtctgcaacatgtatgccgatatgttcgcgtccatgggagacgagctgatgcagcagagagcaaccgatatgcgtgatatcaagacacgtatgcagaagatattactcggggtcagttccgtggatatcgcctcactgcctgctggcagcatcatcgttgcaaaggatttaaccccatccatgacggccggtatcaatccggacaatgtatgtggtatcgtaacggaattaggcggaaagacctctcacagcgcgattctggcaagagctctggagattccggcggtggttgcggtagagggttttttacaaaatgtaaaagacggagatactgtggttctggacggatcggaaggaatcgtattcgtgaatccggaggaaacggtcactgcagaatatgagacaaagagaaccgcttatttaaaagaaaagaaggaactggaccagtacatcggcaagccaactgtaacgaaggatggcgtgaccatcgaactggtggccaacatcggcaaaccggaagatgtggacaaggttcttcagtacgacgcggaaggcattggcctgttccgtacagaattcctgtttatggaccggaattccatgccgactgaggacgagcagttcgaggcgtatcagaaggtagccattgccatgaacggcaagcctgtgattatccgtacactggatatcggcggcgacaaagagattccatatatgggattaaagaaagatgaaaatccattcctgggctaccgggccatccgattctgcctggaccgcagggaagatgtatacagaccgcagcttcgtgcgcttctgcgcgcaagtgcgttcggcaatatcaagatcatggttccgatggtaacatgcctggaggaattccgggaagcgaaggctatgatcgaagaagtgaaggcagagctggatttaaagggaatcgcctataagagagatatccaggtgggtatcatggtggagaccgcagccgcgtccttaatggccgatgcgttcgcgaaggaagtggatttcttcagcatcggaacaaacgacttaacacagtacaccatgtcggtagacagaggaaatgacaaggtatcctacctttactctccgttaaatccggctgtactccgcagcatccgccacatcatccagtgcggccgcaaggagggcatcatggtaggcatgtgcggcgaagcggccagcgatccgctgatgattccgctgctgctggcctttggcttaaatgagttcagtatgagcgcatccgcagtcttaaacgcaagaaagctgatcacaggctacagcatcgcagaactgcagtccatcgctgatcaagccatgtcattcgtgacagcgggcgaagttgaggcatacatgcgcgaactgcagtgagcagtgcgaaaaagagcagagtcaagctgaatttacgaattataaaatcctgaaaggaaggcagctgtcgcattggcggctgccttcctgtgatgaaggagacaaactaatatgggtgtatatctgatttgttacgcagccagttatctgtttgcgagggcggggtattactggctttcgggccttgttcttatcctggcggctgtctggctgtactggtacgattataagaggacggagaatatcattcatcttcgcgggcttttctccctgttctgggttggaggacaggggattgcgtgtctgaagctgtctgagctgtcgtcggactggaatatagtcacatggctctgtttcctggtggcgcttttaggcttctgggtgacgtatgagttcctgatgagggctcagggagagtcgggaggccagcgttccagatggtttaattttcagggctatgagaggccgctgttctggtccatggtcatcgttaccgcggtgtccctgggtgcatttctggcagaggccctgatcctgggattcattccgtttttcgtacggggcgtgccgcatgcgtattcgaccttccatatcacgggagttcactattttacggtttcatgtgtcctggtgccggcgctgtccgtgctctacttctgtatcgagcagggacggaacggcgtgcgtatgatgctggtgctcctcatggatctgatcgcctgtgcgattccggtcctctgcgtgtcccgtttccagctgattctggctgttggactggcagtgctcacgtatatcgccatggacaaccggctgaagatttcttacgccataggccttgtgctgggaatgattcccatctatgtgctgctgacctttgcgagaggccatgacgtttcgtatttaaatggaatcttccagatgaagaacagcgagatgccgatctttgtcacacagccttacatgtatattgccaataactacgataactttaactgtatggtggaatggcttccatcccataccttcggccttcggatgctgttccccctgtgggcgctgaccggactcaagttcctggttccctccctggtggattttccgatctatgtgacgaaggaggagctgacgacggtaacgctgttttacgattccttctatgattttggaatcatcggcgtcgttctgtttgcctgtattctgggcgcggttgcatttctgctggtccggatgatgaagcggatacgcaatccggtgggctatctgttttatgcccagtttgcgatgtatctggtgctgtccttcttcaccacatggttcagcaatccggccacctggttttatttgattattacaggcctgctgtggggcttctgctcctggcgtaatgacggaagacacgggtaatcctgagaggcgggataaccccgtgtctttcgcctgttctccggcacaaagtgccttcgaacaattttgtattgcagatatttacagaaagaggagtaagcaatggaaaaagaagatatcagagtaacacacgtcatcatacatattctggattccaccgtggggacggcggtgatgtcagggggccttttggagcacggatccgatttttccgattttgtgagaagccatatttaccgggtcatgaccagcgacgagggaaaatcctgtcagtttgacggggattctccggtttaccagatggtctcggagatggatgaggacacgtttatccagaagtctcaggagatcgcccagaagctgtttgatatcatgtattccaatatcgatattccgtccgcggatttgatggtagtgcggtacgacgcgggacagcagtgcggaattgccctgcttaagatgaactataagtcctcctatactcatatgacgaactatacggaaaatggaaactgcaacgacattatccggcagaatgccattcttccggcggaaaatcagaagctggcggaggcgtgtctgatcgacttaaatgattactctctgcgtgtgatggagaaaaagtatgaggtcaacggggtgaagaccaattacttctcccagatgtttttgcagtgccacggcagcatgtctccgaaaacggagctctcgatcgtaaccaaggcagtagaacaggtgcagaagggatattatgatgagtctgagcagtgggaagcccacatggaggcgaagagtatcttaagccaggagctggcggagcagggcagcatcgacattccaaccgtagcggaaaagattttccacgaaaaaccggaactgaaggaagaatttacggaaaagatggaaaaatacaatctttcggaaaaacaggtgacacctcagaatccatctaccaccaaaaaattcgaaaaacagtatctgaccacggacaccggtatcgagattaagattcccatggaggaatatcagaacagaaactcagtggaatttattacgaacgcggatgggagcatatccgtgctgattaaaaacatagggagcattaccagcaggtaatgctccctatgttttttgctgtcatttatgtatttaatctttatgaatccatatcttcgtccgatccctcacccgatttgcgatcttccttatccgatccctgatccggcaattccccggtcttctgtgcggcggctctctttgccttttcttccgcatagatcctgtcgatcttccggttatggcgccggacgatggaaataacaatagccgcgagtagggctaacggaatccagaaaggacatgtggtgatgaagaggatcagtaaattcgtcagggctgtgacgatggactcgaaattctttgcgagcccgtttttaattcgtgctccggtcgtctccggtgtgacaggcgtgtaggccgtcacttctgaaatgcttaaatagacggtgctgtaatccacctgattgtcatagaggcgaagctgggattccatggattccagctggtagcggatatcagagagccgctgttccagcgtgatgaccgtatcgatggactcggccttctccaaaaactgccagatgcgttcctgctcgatctccagtgactttttccggctttccacgtcgctgtactgaagtgttacgtcctgcgtggactctgatttgttggtgacgttcccgctgtcactgactgctcccacgaaacggtccagtttatcgttgggaatgcgtgcggtgatgttgccgtaccggggaacgggctctccgcgatagttcaagctggtgccggagatatcggactgttcaatgtacccccctgcttcagacagtttggcattgatgccggagatcatcttgtcgaattcttccgtctccacctgcatcgtgatgttgcggatcagtttgcgcccttccggcaggagcggagtacctgacgtatccatctccagttcgccgccggaaccgctttcggatttctgagatgcagagtcataggtcatggaggtgtttgacacggtttcggcggctgcctctgtgtaagccgccgtcgtttctgctaccattgaagatttgctgcccgagccgcatgcggtgattccgaccacaacggcaaagagcggaatcataagtgaaaccacttttttcataataattctcctccctgagaatggattaaatttggtttcagggcgtacagatgacagaaagcaattttctactacgccctagtaagagaataccatggcagaaaatggattgcaacgaaagtaataaaggattaagaaaatattagatgtttggaaacaatattaagataaaatgaaaaacaaatctgcaaagacgaaataaaagagaaagaatgcatacttgacagtctatataaaaggcggtaccatagacttatagaaaaaggaatcgcgctgggattatcggaaggttccggtgcggggaagggagaaataatatggggaagaagtggatgaccgctgttgttgccgcggcgctcagtgtggtaatggcatcatcggcatttgccggaacctgggaaaatcaggagggaagatggaagtatcacaacgatgacggcagctatgcggcagcccagtgggtagaggaccagggaacctggtattacgtggagcaggacggctttatgaagaccggctggttccaggatggcgccggagtatggtactattttgatgagaatacgggggccatggtttctggcacaacccggaatatcgggggaaccgattatacgtttgacggttccggagcgtgggtacagccgcaggtacggctgaatgacggctggaacgggacgacctacgtgaaccggctggttggataccagattacactgccggattcctatcaggctgtttcggggaataccgtctctctgccggaggaggcacagtatgacatggtggcatcagcgcccgacggcaacagtatcatcgtcaccgccattatcaatatgtctgagctggacggggaaaactggtcggatgaggaactggcctattactttaaatatatttatagaagcgaaagcgatgtcattggcgcttccttcaacgatctggggttcgcaaagatcacgttaatacagagtgaagaggggattgccgatgtctatttcaaacgctgcggctcctatgtactgatgattgagaccgtgtttattccatcgagatggcaggagattgacgatattctccatacgatgaagattccaaactgatggattccaaacggctggattccaaacggatgacaggataagaattacgcacgggcgaagcggtatgcccttatggcaggcagcctgttatccaggctgcctgttttacgtcttcttcgcatcggagggggtggattcaaagtattttttgtacgccctggaaaaggtagaatagtttttaaagccgcagtcaaagcatacactggtaacgggcgtcccgctgcgaagcagatcccgcgccagtaaaaggcgtttttcggttatgtaatttccaagggtatagccggtggcctgtttgaacaggtgcatcagatggtagcggcttaaataagcggcgtcggcgatttgatctacggtcagatcctctgtcagatgcccggctatgtattccatgactgcggagattctgcggtcgccggtgccgggggagatgtattccacccggccggtcagggcggcgcggtttaatttgatcatgaattccagaaataccacctggcagtacagctctttcgcgtatccatcgtgggcgcaggcgtattctaaatcggtgatagtcttaaagagtccgctcttctccaacgaatgaatccgcagcacgttggaacgcagctccttcgccttatggaagcagtcgcttaagtcgtaggtgtcggaccggtaggaggtgatgaagcggggggagaggtagacgatgatccgttcatagggaaccgacggatcgatgtccggcctgtgaatatcgttatggctcacaagtacgatatcgtaaggctgcagctcatacgcctggccttcgatccggtatgtcacacggccccggatgaagatgataattttatcgaaatcgtggtagtggtattcaaaatcctgtttttttgtatcggtcaaatggaacagccgaaagtcgctgtttaggtatcctcttttttcatagccggtcataagttcttatttcctttccttaacggttctattatacagcaatagacacaatatgcaataaaaacagcataatatcgatagaaatgataaataatgctggctataatagagggaaagaatgaatgacaaaagagggaatttatcatgaagattattgttttagcaggcggatacagtccggagcgggatgtgtccctgtcctcgggctctttaattgccaatgcgctgatggagcggggccatgaagtctttttcctggatccctggctgggaattaaggcaggggagcgggttcattacaggaccagggaagaagggctgggctttgcttacgaaatcggcggggaagcccctgacttagagctgctcggagcagagaccggtgcgaaaaaatcactgattggccctggcgttctggaggcatgtcgggaggcggacatggtgtttatcgcgctccacggcagcacaggagagaacgggcagatccaggcagtactggaggcgtacggaattccccatacgggtagcggttatatgggaagcttactggcaatggataagaatatttccaagattttgatgcgggcggccggagtggctactcctgactggtatcttgcagaaaagggaaaatgcagtcagccggaattcctgccctgtgttgtaaagcctctggactgcggttccagtgtaggagtcacaatcgtagacaaggaagaagaatggcatacggcgctggaagccgcattttcctatggcgaccgcgtgctggtggagaaaaagattacgggacgggaattctctgtaggcgtactgggcggaagagccctgcccgctatagagatcataccggaaaaaggattttacgattataaaaacaagtaccagcccggcatgaccagagagatctgtccggccgggatcgatgaaaagcaggagtcaaggctggaggccgccgctctgacggttcatcgtatcctggaactgggatactattccagagtcgattttctgatggatggagacggcgccatctactgtctggaagccaacacacttccgggtatgacgcctttcagccttcttccgcaggaggcggaggcagccggaatcacatatcaggaattatgcgaagcaattgttaaaaacgggaaaggagccgcattatgaagattacgttagagaaataccatggactcggaaacgattacctgatttttgatccgaataaaaatgaattaaagctctcaaaggaggcggtacggctgatctgcaaccgcaatttcggcgtcggatcggacggccttctcgttggcccgattctgggggaagacaagatgacggtgaagatattgaacccggatggcagcgaggcggagttaagcggaaacggtgtccggatattcggcaaatacttaaaggatgcgggctatgtgcagaaaaatcatttttcggtcaacaccttaagcggggaacagcagatccactacctgaatgaggaaggaacgagaatcaaggtttccatggggcatttaagcttctggagcgacgaaatcccgatgacaggtccgaggcgtgaagtcttaaatgagacgatgatgttcggcagcattccgtaccgggtgacctgtgtctccatcggcaatcctcactgcgtgatctggctgagcgatatctcaaaggatctggcctgccgcatcggccgccactccgaagcggctgagtgtttcccggaaaaggtaaacaccgaactcctcagggtggtggacaggaccaacatcgaaatcgagatctatgagagaggcgcgggctataccctcgcatccggaaccagcggctgcgccgccgccggagcagcctacaagatgggcctcaccgatcccaagatgtacgtccacatgccgggcggagtgcttgaagtggaaatcgaggaggacggctccgtcctgatgaccggagacgtgggctacgtcggtaaatttaccttatctcacgaaatggtagagcagctgcgcagcctgtgagtcctggtattgacagcttgaaaagcgggtgaaacttgccgtaaggatgtatcctgtatacatctttgtgtgggcaaatttcacccgccttttcgttctgtaccgcaattttctgcgcccaacatcaatttcgttttgttgacgtaccccctcccatagcttataatagataataattgcgatagaatgccggcggtattgactgcggcagagaggcggaacgtatggatcaattgccagtggctggagaaggtaccggcatttatgttatagacgaagattacaggattgtctacttcaatgaaacagcaaaggctgtctgcccgaatttaagagtagggatcacctgttatcagggaatctgtaatggagattctccatgcagcggctgtccgggcatgaaggtggactgcagccatattctgttttacgacgcggtgaaccggcagtggcttgaattgtcgtcgggacaggttgagtggcctgggtgcgggcggtgctggctgatgctctttaagattgtggacaggcagagcaggagcctgttttacgatttgacggagaccagtgtctatgaagagctgttcgagttaaacctggcagagaatacctataagatactcttccatcagaatgggaaatacgtgattcccgccatggagggaagcctggataccatgtgtatggaggttgcggatcatatgattgatccggaggaccgggagcgtttcctggagttctggaattttgatacgctgtcacagcgcctgagcggagaaaaccacaccataagaggggaattccggaagcttcttgtgtccggggagtactgctgggtggcccagaccgccgtgctgctgcggacgggggagcaggataagacggttatcatggtctttatacaggacatcgatcagcagaagaagcaggagactgcggccccggacagaggcggaagcaggctggaagagaaggattccatgacgggactgtaccggtacggcctgtttctggagagagcggaacagtttctccgggaaaagcgcggcataaggttcagtatggtcgccatcgatattgagcatttcaagctgtttaacgaatggttcggggaggaggccggggaccggttcctgatcagcattgcggagcagttaaaagaagtcgaaaagcagtgcgattccatggccggctatatgggcggcgatgattttgccatcatcattccgagagacgagtcggttcttgggaatctggagcggggaattaagcattttgtgaagcagtacgggggaagcgccggcttccttccagccttcggtgtctatgagatagaggattggaatctatccgtcagcatgatgtatgacagagcctccatcgccctttccacggtcaaggggaattacctaaaccgtacagggcggtacgacgcgggaatgaaaaagaagatggaggacgaccaggtgcttttgtcggaggttcagagggccctggacaaccgggagtttatcttctacgcccagccccagtgcaatatgctgacgggaaagattatcggactggaatcgctggtcagatggaaccatcccgtaaggggcatcgtacagccgggagaatttattccccttctggagagcaacggctttattaccaatctggacctttacgtctgggatatggtgtgcggaaggcttcacgactggatcgctgcggggcataagccgattccgatcgcggtcaatgtctccagaatcgatatctattccatgaacgttacgaatacgtttgcagagcttacgagccggtatgagatcgatccggcgctcctggccatcgagatcacggaaagcgcctacgccgaggattacaatctcattcgccaggtggtgatcgatctgcggaatgcgggctttaccgtctttatggacgactttggaagcggatactcctcgctcaacatgttaaaggatgtaaatgtggatgtcatcaagatcgacacgaaatttctggatatgaacgagtacagccagaaccgcggcatgggaatcctggagaccatcgtccgcatggcgaggctgacgcagctgcgggtgatcgcggagggcgtggagaaaaaggagcaggtggatttcctgagaaatgtgggctgtatctacgggcagggctattactactaccgtccgatgccgatcgaacagtttgaaccgctgcttctccatgaagagaatgtggattaccgtggcattcaggcccatcagctggaggaactccgcctggaggaccttgtcaataaggatgtgaccagcgaggcaatcctcaataatatgctgggcggaatggccctttacgatgtctgcggggaaaagatcgagctgctttctgtgaacgaggggtattaccgggtgaccggctgtaatcccatcgatctggaggaacgcaggaaatttattatggcgcagatacacgaggatgaccagggcaaggtgctggagctcttcgaggcggcctgcagaaatccgctgaagggatcggaaggcatcatacggcgctacaggctgagcggagagctgatgtggatctccctgcgcatctttttcttaaaggaaagggatgaccacaggctgttctatggatcggtcagcgacgtgacaaaggtaaagcggcaggaagagaggctggcttcctcccagcggattctcgcggatgtcctgaatatcaacggagatgaaggcgcatttgagccccagatgcttaagacggccggagaatccattcagctgcagaacgacgaactggagtttctggattccggcgttccgggcggttttcattgctgccggtggacggaggacatggagcttctctatgtcagcaggcgttttctggaaattctcgggattaccggtcgtgagctggaggaggagtatcagaatcagatggtttcgctcatccatccaggcgaccgggaccgggtgctatccgctgttatggcagagaaacagacagtatatagcctggaattccgtatgcggacgaagacgggatatgtatggatccgctatcaggcgagacgaaaacactggaatggcagcacatttttatatggagtcatcctggatatcgatgagattatggcattgcgtcaggagataaaagagtgcagaaaacgattggaagaactggagcgatgcaggcctgtggagacggatctgctgacgggtctccataaccgggagacggggattcccctgatgaaggagtggatatccaggcgcagagtccagccgtccgcgctggcactgttccggtttcacgggtttccagaggtgaatgaggcgctgggacaggtgagtggggaccggatcctggtgaacagtgtggagaagctgaagagctttttccgtgaggaggatatcgtctgccgcatcagcggatatgagatcctggtgctctgtaaaaatatcgggagcagggatatgcgcaggaagctggaacagctgatggcggatatgaagatggagctgtccctggagtcggcaaagatccggccttccattaacgcgggatatgtgatggctgcggacggaagcacagactttgatgatctttacaaaaaggcggagaaggcgcttgaaatggcgtcttcccaagggaaaggcatctgcctgcgctgcggagaagacatcgtggattagccggaaatgagaccgtgagccggggaactgccaggtgtgaaaagacgcctgcagctgtccccggctcttcatttttgttatagaccttgagttcctggtatggtatactatgagcacttggtgaggtagtttacgcaatgcagcaccagccataaattcagaaaaaagtgagggaatgaggatatgatagctgagaagatgaggccccttgttgagaataattctgccattcgggccatgtttgaagaaggaaaacgcctggccgccatctacggaccggaaaatgtctatgatttcagccttggcaatcccaatgtaccggcgccggaggcggtgaaccgggcgattacggatatcgtggcggaagaagcgtctaccatggtccatggttacatgagcaacgcgggcttcgaggatgtccgggatacggtggcacagtcgctgaaccggagattcggcacacagtttcatctggagaatattctgatgaccgtgggcgcagccagcggtatgaacgttattataaagacggttctggatccgggagacgaagtgatcgtatttgccccctattttatggagtacggcgcctatgtgagaaattacgacggagtgctggtgacggtgtccccggatacctcctcatttcagccgaatatctcggagctgaaggagaagattacgagacggacgaaggcggtcatcatcaatacgccgaacaatcccaccggagtggtctattcgtcggagacgctggaacagattgcggcagttatgaaggcaaaggaagaggagtacaggacttccatcgtgctgatatcggacgagccctaccgggagctggcgtatgacggggtggaggtgccttatgtgacgccgttctaccataacaccgttgtctgctactcttacagcaagtccctgtcgcttccgggagagcggatcgggtatctggtgattccggatgagatggaggattcaaaggctgtcatcgcagcggcgaccattgccaaccgtgttctcggctgcgtgaacgctccttcgctgatgcagcgggtgatcatgcgctgtattgacgagaaggtaaacgtggaggcctatgacaggaaccggaatctcctttacaacggcctcacgggattcggcttcgagtgtatccgtccggaaggcgcattctatctgtttgtaaaatctccggaagcggatgacagggctttcagtgaagtatgcaagaagcaccgcctgctggtggtgccgggaacctcatttgcctgtcccggatatgtgagaatttcctattgtgtgtcttatgagcagattgagcggtctctgccggcctttgaagcggttgccggagagtacggactttcatgacgggaggaagagcgatgaaaccatgggaggcaaatatcagaaaagtagtcccttacgtgccgggagaccagccgaggggcagccatttagtcaagttaaatacgaatgagaatccctatccgccggcgccgggcgtaagcgcagcgcttaaggagatggattacgatctgttcagaaaatatccggatcctgcatcctcggttcttgtggacgcactttccgaatattataaagtggatagagatgaaatctttgtaggggtgggatccgacgacgtgatcgccatggcgttcatgacctttttcaactccgataagccggtgcttttcccggacatctcctattccttctatccggtttgggcggagcttttcggcgtgccctatgagaaaacggctctggatgagaatttcaagattgtgaaggaagagtattaccgtgagaacggcggaattattttccctaatcccaacgcgcctaccgggctttatatgccgctttcggaggtggaggacatcgtttcccataaccaggactcggtggtgattgtggacgaggcctacattgattttggcggaaccagcgcgcttaagctgaccaggaagtatgaaaatcttctggttgtgcagactttcagtaagtcgagatccatggcgggcatgagaatcggctatgccatcggaaatccggccttaatccgcgccttgaatgacgtgaaatactcttacaactcctataccatgaatatgccgtcccagattctgggggcgaaggccgtggaggaccgggcgtatttccaggatacggtggagaagattatccgtacgagagaacaggcgaagctaaggcttcacgagcttggctttaccttccctgaatccatggcgaactttatctttgcttcccatgagaccgccagggcgaaggacatctatgaggcactccggcagaacagcatctttgtgcggtactttaatcagccgcggattgacaactatctgcgcattaccatcggaaccgatgaggagatggatgccctgtaccgctttttgaaagaatatctttagattttcttcatttgtaatggttccggccggggagtataatgaggacaggtgatgattatgaataattggaagaagtactgcaggttaattctcaatattgtcatacccctgcttgttatctggctggtctgttttataggaccgcgttttttgaagtttttcctgccgtttgtcatcggctggattattgcgatgatagccaatcctctggtgaagtttctggaaaaacgggtgaggatcgtgagaaagcacagctccatgctgattgtggtggcggttctggcgcttattatcacgcttctttactttgtgattacgaagctggtatcggaagctgtcggtttcgtgggcgacatcccgaagtattatgaatcggcttccgtggaagtccagaagatgttgattcaagtggaacggctcctgcagttcctgcctcagagcgtttcagactccgtaaaccagttcttcggacatatcggggagtatttgaacctggcagtgcagaagatcgcaagccctacggtgaccgttgccggcaacgtggttaagagtattcccgcggcactggtatatacgattgtcacgatcttttcgtcctacttatttatcgtggaccgcgataagatactggaattctttaagaaatacatgccggagggcggatcgaagtattataagtatttgaaaaaagatataaagcatctggtgggaggctattttctcgcacagttcaagatcatgtttgtaatcgcagtggtgcttgctgtcggccttctggtcctgagagtcgattacgctcttctgatcgccgttattgtggcctttctggacttccttccggtgctgggaaccgggacgatcctgattccctgggcggtaatcaggctcttttcaggagatactgcctttgcagtggggatgcttgcgctctacgtgctcacacaggtactgaggcgtgtcatagaaccgaagatcgtgggtgataccatggggctggatcctcttgcaacgctgttgtttctgtatctgggctttaagatcagcggagtcgcgggtatgatcctggcggtgcccatcggcatgctgtttctgaatctgtatgagttcggggcatttgattccctgatctacagtgtgaagacgctgcttcacgatatcaatgtgttccgcagggaatcggactgacggaaagcgagtaacgaattggaggaaggaatgagtaaaatcaggaacgagaaaaaaggaatccgtctggcggcgggattgatggccgtcatgatgatggctgctgtgccgtttacggcggcagcggcagagccgtgggacaaggaaaacggtcagtatgtggacgcgtcgggggcgcccatagcgggagcgctggagaaaggcattaccgtgacgaagtatcagaaccgggcgaacgcggacaagggcggcatcgactgggcaaaggtcgcggccgacggcgtgaatttcgccatgatcagaatcggatactacaaggacatggatccctactattccatgaacatgcagggcgcgtcggaaaacgggattaagaccggtgtatttttctacacacaggcactcgacacccagagcgccatagacgaggcgaattacgtgctaaagatggtgcgggactatccggtgtcgtacccgatcgcgtacgatgtggaatcgcagcaccttctggacaacggtctgacgaagcagcagattaccgacaatattaacgcattctgcaaagtgatatccgacgcgggataccggccagtcgtctatgcgaacaacgagtggctgaccaatcacatggatatcagccagattccgtacgatatctggtatgcgaggtacggaaccatcaacaactgccagaacagaaccatatggcagtgcacggataagggaaaggtagatggaattaccggtgacgtgaccatcgaattctcctttgtggattacggaacactgattccggcggaaggctggaagcatgtggacggtaactggtattatacgaagaattacgtgaaacagaccggctgggtctcagtagacggtaagtggtactacttagattccaatggcgccatgattcacgacacgactatgaccatcgacggggcatcttatacctttggccctgacggagcgatggcagaataagcgaaagaaaattgggatacaggatggataacagaaggtgaaggcagagaataatttagattcagatgatatgagaggactggtatggaggcttgcgtttccctccatgctggcccagtttgtgagtgtgttttacagtattgtggatagaatgtatatcggtaatatcgccggaacaggcgaaatcgcattggcaggagtaggaatctgcggcccgattgtgaccctcatttcttctgttgcttttttagtgggtgtcggcggttcccccctcatgagtatacggctgggggagaagaatgagcgggcggccagacagattctggcaaactgttttctgcttctgaccgtgctgtcagcggcgattacagtgatcgccctgctgatgaagaaccatttgctcatgtggttcggagccagcgaggccacgtttccttatgcaaacgaatacataacgttttatctgctggggacggtatttgcgctcctggcgacggggatgaaccagtttatcatctgccagggctacgccaaggtggggatgaagtcggtcttaatcggcgcggtgtgcaatattatactggaccccgtgtttatctttgtgtttcacatgggagtgcgcggcgcggccgtggctacggtgctgtctcagatggcttcctgcgcctacgtgcttaagttccttttcagcgagcgggcgccggtgcggatcaccttcggggaatacgactggcagatcatgaagagagtccttttaatcggcttaagtccgttcctgatcatcgcgtttgacaacattctgatcatcgcattgaatactgtgattcagaagtacggcggcgcggagcagggagacatgctgctgacctgcatgacgatcgttcagagctttatgctgatggtcaccatgccgcttggcggtattaccagcgggacccagacgatcctgggctataattacggcgcgagaaggccggaacgaatcaagaaggcagaggtccatatcgcgatgctggggcttgtgtttaccacggtcatgttcctgatcgcccacaccattccccagtttttcgtccggatcttcacacagaatgagacgtatgtggaattgactgtctgggccattaaaatctatacgttaggcataattcctctggctgcgcaatatactgtagtggacgggtttaccggtatggggatcgcacgggtggcgattacactgtccatgttccggaagataatcttcctcggcggcgcgtttctgattcctgcaaccatgggaatcaaatacatattttatacggaacctatttccgattttgtcagcgcagccgtatcggtgacaatctatttcctggtcatcgacaagatcatcaaccggagaccggtattgggaaggcagaaagcctggtaaaacgttgcgcaggaatttaagcagcgctgtaccaacagcacgtccggacaggaggaacaaagcagtgatgcgaaaatggattgccgcagccgctgtgcttttgtttggcacatggggtacgggacaggcctgggcagggacatggcagtatcaggccgcagaacagccaggccccggtacgaaggagagtggctggcagtaccaggaggatgacggaacatttgccccggaaggctggattacggatcagggcagatggtattacataggagccgatggatttatgaaaaccggctggatagagcttcaggggatctggtattatctggaggattccggagcgatggtctgtgggacaacccgtgtgatcgacgggacggagtatacctttgacgataacggcgccatggtggaaggacccggcgtcacaccggcggcggggagctggaacggaatgacgtttaccagcccccggctgggctatcaggtgacggttccggaaggcttcgtgccgctggaatcctatatggatttatacgtggatgagaccatgaccctggatctgtcggtggcggcaccggatatgacggtgtccatggtggtggtgacgtatgaccagatggacgaggagtttaagggaatggatgccggacagctggccgcggtgatggggcagggactcggcggatacgacgagtacatgcagatcggagcggtggagatggtcacccttggcggccgggaatacgcgaagctgccggtaatctatacgggacttctcaaccaggatctgtatttccggtggtcgggagagtccattatgatgatcgagatcgtctacgatccataccggaaagatatggcggacggaattatcggatcgatccgatgagactggggcgcggatctgcgtcggcagtgagacaaacgggcggaggcagcacggatttcaggtgcagcctccgcccgttttgggtatatgtgaaagaaaaataattataattgacatatgtcaagaattgccttataataaatgacatatgtcaataacatctgcacaagggaggaaacgatatggcacggcccgttaaggcgagacggatatgcggaataccgggaagaatgcggtttgggccgctggaagcagggacaggcccggggacggaccagatcgaagcagggacaggcccggagtcggaccagattatttccctgacgctggaagagtatgagacgatccgcctcatcgactatctgggctgtactcaggaggaatgcgcagaccagatgggtgtggccaggacgacggttcaggccgtataccagtccgcgaggatgaagatagcggccatgctggtggagggaagcgctctttccatctgcggagggaactatgaggtatgtcccagggcgggcggatgctgtaaaaaggactgcagaaagcgacgctgccccggacgcaggtgtgacggacaagaatatcataatggaggatggaatcatgaaaattgcggtaacgtatgagaatggcggtgtgtttcagcattttggacacagcgagcagtttaagatttatcaggcagaagagggaaccgttgtatcttcagaggtcgtgggaaccgatggaaacggtcacggcgcgctggctggattcttaaaagggttgggagtgaagactctgatctgcggaggtatcggcggaggcgcgagaaatgcgctgagcgaggccggaatcgaactgtatccgggtgtgagcggagatgcggaccaggctgtggaggcgctcttaaagggaacgctctcctacaatcctgataccatgtgcagccaccaccatgaaggcgaagcgcatgactgcaatcatggcggcggaagctgtcatcactagtaccgccagacctaaatacgtactatgcagtacgcatttaagtccggcggcactagaatgaattttcaaacacgctctaaagctctgttggtttaaacagggctgtcttcccggcgtttcgcgggaatctttatggtcacctccgttcccattccgggagaactctggaaggtaaggccgtaggaatcgccgtagagacgcttcagacggagattggtgttatagacaccgatgtgtacagaatcggaggttccatttgccatgggatctccgtttccttctgccagaatggattccagcttttcgggaggaatcccgatgccgtcgtcggagatgaggaagacaatgtccccgccctgccgccagcccgtcagaaggatgttgccgcttttttcttccttgtccatgattccgtggagccatgcattctccacaatgggctggaaggtcagctttggaatggtatattcggacagttcatccggcacatccacgacgaagctgacgcagtcgtcgtaacgcatgttctggagctccacgtatagctcggtgtgttctaactcttcctcgatggtgttcataagcccccgcttgctgagcgtcagcttatagaagcgggagagcgtctggatcgccttcgtaacgtcttcttttcgtccggttctggacagccagttaatcatatccagtgtattatagagaaaatgcggattaatctgcgcctgtaaggcccggaattccgccagccttaagtcttcggaggccttctcctggctgttcatcagatcgttgatctcttccgtcatatagttgtacgtgtcggtgaggacgccgatctcgtcacagccggtctcctcggcctccatcggcctgggccggcctgtacggacggattccatctgataggccaccgcgatgatacggtccgcgatggagacggaaagcttcagggcgatgaagagggcggcggcggtgaagaggaggtaggccataatcagctgaaccatcagattccgccccgcgtcggtgatgtggctggagggcagcagggagaccatgtaccagtccgtgttccggaccgggaagtaggccgtatatgcgtcgccatccggatacgccaccagggaaaatgtcttttccggaccgatctcggaaaagaattcgtccgcgggaatgtagtagatccccgcaagggccatgtcggaggcggataccatcacgtcacggctgttgatgatgtaggctgcctctcccttgaccgaggcgttgttaataagcgcggagtcgaagggctcaccgttaaaatacactgccagataggcggaggcctgcacaagctcctgatcggaaccgacaggcggcagataggtgatcttggaaatataggccaggcggccgaattcccctgcttcagacggacttaagtagagctccgggcagagcagctccctatcatgcatggtgctgaagattccgtaccagtagctgctgctgacagaggagactggagcaaacagccggttgccctcggtattgtatttcatcagatcagggtaaacggaatcatcgtagtagatgcggattcccgtgatcatggtgttgtcggtcaggctgtccgtcaaatgaaacaggctgtccattcggttctgctccggctcaaacgccgctgcatcgctctccgatagatagaagaggcggtggatggaggaagactccttgagtgcgtcggatacgtaggtcacgtgggacaccagattctcgatcgatgccgccgtctgtgcagataaggcctgctccgagcggatggagtcgtccatgacgatgccgtaaagctttacgaaaataaagcctgataagaccgctgtgggcagcagaattaaaagagcgtgggagataacaagcttattctttagtttcaggtcatacgtatagtgacgcatcattcgtctgaagaagtttctcatgaaagtattttctccctgtattcagaaggggacaggcccaccagcttccgaaaggtcttgctgtaatagttgccgtcgctgtagcccaccttggaggaaatatcggcgatcttataacggggatctcccaaaaactgcttggacttcttgatccggtaattggtcagatactggttcagtgtctgccccgtctcatttttaaacagcgtgcagatatagctggaagaccggttcacgtattcactgacatccagcacagagagcgaggagatggcatagttctggtgaaggtattccttgacctgaaagaccaggggattctcccccgtgtcccggcttaaatggtcaaaatactgttcgattttctctgccagcaggctgtgcagctcggaaaatgtgcggcagcggagtacgctgtcccagatggactgaggatttactccctcgctgctccacagggaaacgtagttcatgatgccgttttcgtccagctttacaaggtatttgtagtagatatccttcacctggctgggcagaagcggctggccgttcaagatggagtcgtggagctgtctcaccagctccagcgccttctccttctgcttttccgagagggccaggccaaagtccatcagcacatcggcgggcgggcagagggctgccggtttatcgtaatcggtcaaaatggaattgaactcgtgaaaaaagctgttttccaggaggagcttcgccttctcgtaagagagatggacggaggcggcgcccgtgacgatggggcctgccgcgaggaaaaagcggcagtatttgtcgaaactctcctgtaagaacagggcgcatcgtttaacggcctccttatcaggctttttctcagaatatatatgtacgatcacatagcggtcggagcggaaggcatagacctgctttaatcccagttcctttaacaagatcaggaaattctcccgcgcctcatccatcgggatctccggaagctcggagagcggcgtcatgctgtccacgatgattgtgaaaaacgaggtggcgggaccgatagtaagctccagctggctgctcagctccagcgctgccgcctcgctgcccggaagcgacagaaggtgggccagatggcctttctgctccttttcctgtatcatgacggcgctccgcgtgtggttgcgcacctggcagtttaacagggcctcggccagggcgtcgtcgagctcggagaggctcagtggtttctctacgtaacggacagccttcagtttaatggctgcctttaaatactctttatcagaataggcgctcatgaaaataatagcggtgtcaggattcttttccagtatggcttctgccatctcaacacctgtcatccggggcatcctcacatcggttaagacaatgtccggctgttcggagaccgcagtctccaggccgtgtaccccgtcgtcggcgagaagtatggagtcaaaaggcagagaaagcctggcgatgctgtcacggattccttcgcgggtcagtttttcgtcgtctacaatcagcagtttcatcgtatctttctccttccaaaaatgcgggaacgccagaacgttcccggtttcatgttttgtaaacatggtatataaatattgtaacaggaaataggaaatatgcaacgaaaatagacaaattaccccatgggtagtatactggaatataatggaaacaaaagaggagacagcggagggaagacggtgaaacggttctggctgataataggacttctgacccttttaagccttgcggcgtgcagtgctgcggggctggtggcggagaatccggaatatgcaataatcatgaaatcgaaagataaccagtataatgaagaagtggcggaatcgttccgccaggtgacagaggaagcgggatatcgctgcgaggtgctgtatccggaatcggcgagggcccaggatcaggtgattcttgtgcgccgtatgatgcgggagagggtgaaagccatcgccatcgcggtcagtgacgaacatgcgctcgctcccgtgttaaaggaggcgatggcaaaaggaatcgtgatcactactttagattctgacacggaaaaggacagccgcagcatttatgtgagcccggccgatccaaaggagacaggcgccagtctggtgcacgcggtcagggactgtatggatggggagggccagtgggcaatcctttcggcccaggcccgttccgccaatcagagccagtggattcacgccatgatggaagaactggaacagccggagtatcagaacatgcgtctcgtggatattgtatatggggaggatgattataaggcctccgaagccaggacgagagagctgattgagaagtacccggctcttaaagcgatctgtgcgcccaccacggtagggattaaggccgctgcggatgtcgtaaaagagcagggacttgagggacagatcagggtgacaggtcttgggattccacccatgtctgagaaagacactgtttctgacggcgcctgcgtgtgcccggagttaaatctctggaatccggctgctttaggagagctgtctgcccaggtgtccatggcactggttaatcaggagcttacagtgagagaaggagcggtattcaaaacggaagacggcagggactatccgattcacgagggtgccggcggcggtctggaggtgacggcgggcgatcccgcatcaccggatgagggcggcagcggcctgtgaaacggggataaatggcaaaaacgaaatattttccagtatttagaaaaatattaccgtagaaatgtcgaatcgtgtcgtggtatgatataaactgtcagaaaacaaaggggtgataaaaatgaagcatattttcgtaacgtttgaccaggcagaacagatcttttcatttgtaaaaattatgagcaaatgtgattttgatgcggacgtaaaactgggaagccgtatagtagatgcgaagtcgattgttggagtgctgtcccttgctaaatcgagaacagtagaagttatcttccatacagataactgtgataatataattgatcagatagcagctatcgttcccatcgctgcgtgaagaaaaagcaaaatcaggccgaataagccatagagtttcaagtgccggaaggcagagaaagtaaaaggtagaaccgtttactttctctgccttctttttgtgtaacagctgcttcagaggggctctctcatgaacccgtggactggtaatgggacaatccgaaacgccacaggcaggccgccggaattaagaagaggcaggcgggcagcggaagaagggcgtaccagtccctggccgttttgccggtcagatagaggaagggatagtactggaacagggaaaacggcaccaggaaggtgcagatcgtgagcaccgtctttccgtaaatggcgaccggatatttaccgtattcccgcgcaccatccgtgaacacgttcatgaactccagcccctccagagtgaagaaacagatggaggcgaagatgatgtagacagcggcaaacacgagggttccgcctccgatcatgaggaccagcgtgagcacccgcatcggtgtccagagaataccgcttttcgccactccgtaagccagcatgacgacagcctggagaagccgtccgatccttgtaagctcgatcttgctgcacagcaccaggaagacgcagctgcccggccgcagcaggatccggtcgaattcaccgtttccaatcatcaggttgaaggtatcgaagctgcggaaaaatgtctccgccagcgtgtacgccatcagcgtgatggaaaaacataagagcacctccggatagatgaagccggaaacctcatgaaaacgcgtcatcatgaagtagacgcccagaaacgcgttaaaagagacgagaaactgtcccagcatggtgaaaaagaacgaagccttgtgctgcatcatgctttttaactgcatttcaaaaaaacgaaaataaagccgtactgctttcataaaagattcctcctttttctcaaccgccctgtatgacaacgtgtttcaatgcatggcgttccatggcccggccggcggccagcatcacaagcagccagaagacctgcagcgaaatgcttaagtatatctcatggccgctcaaatcaccgccgaagatgcggaacggcacattctgtatggaggcaaagggcagcaggctgacgacagctcctatatttcccggcaaaaagggcagggggatgacggcgccgctgaaaaaatcgaagagcgacgagacgatcagccggattccctgagaggaaatggtataaaaaacagacatatagaccaccatgttaagcgcagtgacgatgaacagcgccagaaccatggaaagtacggtaaaaaaccaggttcccggatgggatggcagtgtgaggccgtagggcttcggaaggagaagggctacgatgagaatcggcatacagcgcagcaccgccttcgacagacggacggccagactccggacataccacatattatagaggcgcacgggacggcagagctcgtaggctacattgcccgtagtgatggaatcaaacagctctatctcccagaaccaggccatgtagagggccaaaaacgcctgctgaagccagacgtaggtcgacagtgcctgaaaggtcatgggaaatgatgaggaatccgcctggtagaaggcccggaacagtaaaatctccatggcgccccagacaaactgggtgaccatgcctgacaccgcggcagtccggtactgcagcccgtgtaggaagcgaatccggaaaaatgagaggtattttttcataagccgcctcctaaatccgataatcgcggtacagatccgcgaccatctcatccaaagtttccccttcttcccggcagtgatttttcagtgactcgaaggtgccgtctaaaagcagacggcctcttccgatcagcatgacccggtctgccatggcttctatgtcctgcatgtcatgggtggtcaggaggaccgtggtgccgtgaattctgttctgtctgcggataaagtcacggactgccagcttggagacggcatccaggccgatggtcggctcatccagaaataagattttcggccggtgcagcagggaggcggcgatttcgcagcgcatccgctggccgagggacagctgtctggcaggcgtccgcatgatttcactcaaggacagtaaatctacaagctcgtcgagtgcatcttcgtaatgtgtctggggaatttcatagatgtcgcggagaagttcgaaggaatcgatgacgggcacgtcccaccagagctgtgagcgctggccgaatacgacgccgatctcttttacgtgttccctccgttccttccagggtatccggccgtcaatgaggcaggttccgctgtcgggagtcagaattccgcttaagattttgatggtggagctttttcccgcgccgttggggcctatgtagccgaccatctcaccgtctccgatggtgaaggtgatgtcgttcagcgcatggacatagtccacttctctgtgaaaaagcgccctgaccgcttcagaaaagccggcgctccttcttgcgactttaaaagtcttgttcacatgttccacttgaatcataatggttcctcctggtagtaatattatggaacgtggactttctgacagaggacagccggctgcagatctgtcgtaacagtgagtgcgttctaatatcttgccaagcggtggaatgcctcaaaaaccgcattcctctccgggaggtgactgtgcagcaggaaatgacgcctgcttcccggggactctaccgtggtatcaatattctcttttcccgattcccggaatgggatgaaggcgggagaaaggaacttcattttagcaccggagagggcaaaagtcaacggaaaaagggtattgacttattcataaaatgtgataatataaacatatgaacagttattcatatgatggaataaaataagaacaagaaggaggtaaatcatggaggatggaaacagaatggatctgcaggacagcgaggcacctcactgtgattttatatcggtccacgaggacattgtaaaccgtgtcatgcaggtgatgccggctgaccagcagcttctggatctggccgaattcttccgggtattcggagattccaccagaatcaggatcctgtatgtactcagccagtccgagatgtgcgtttgtgatatcgcaggccttttaaagatggggcagtcagcgatatcccatcagctgcgcgtcctaaagcagatgcgtctggtaaaattcaggcgggacggaaaaaccgtattttattcccttgcagacggccatatcgagacgattctggcccagggcatggaacatatctgcgaataagagaaaagaaaaaggagagagtaaggtatgagaaagattattaaattagaaggtttatgctgtgcaaactgtgcttcaaagatcgagactgaggtttcgaagctggcaggcgtgaagtctgcggcactcagctttatgacgcagagactgaccatggaggtcgaggacgaccgtgcagacgcgattgtggaagaaagcagaaaaattgcatataagatagaaccggaagcagaattcaaggtactccggtaaacgttaaggagcagcgatgacgaaaaaacagaaaacgatggtagtaaggctggcggtcagcgcggtatttctgatcgcgggagccctgatggaaggaaagacggcttatgcctggattccgtttgtgatttcctatctgtcggccggatatgatattccgctcaaggcggtgcgcaacatttcccatggccaggtatttgatgagaatttcctgatgacagtggcaaccttcggagcgatcggatgcggagccctggaagaagcggttgcggtcatgctgttttatcaggtaggagagttattcagcgattatgctgtcaacaagtcgagaaagtccatcaccgagctgatggatatcaacccggagtatgccaacctggtccgggatggaaaagaagagaaggtcgatccgtatgaagtcgaaatcggagatacgatcgtcgttaagccaggggaaaaggtgccgctcgacagcgtgattataaaaggaagctccagccttgatacgaaggcgctgaccggagagtccatgccggtggaggtaaaggatcatgatccgatcatcagcggctccatcaatttaaacggagttctggaggtccaggtgacgaagctgttcgacgactccaccgtggctaagatcctggaactggtggaaaatgccagctccagaaaggcaaaggccgagaacttcattacgaaatttgccagagtatatacaccagtggtcgtctgtctggcgctggttctggctattattccgcctctgctcacagccggaaactggggaatctggatttaccgcgcgtgcagtttcctggtagtgtcctgcccatgcgcactggttatctccgttccgctcagcttcttcggcggtctgggagcggcttcaaagcagggtatcctgatgaagggaagcaactatctggaagcggtggcgtcactcgatacggtggtatttgataagacagggacgctgaccaccggaaagttccaggtgacacgggtaaaaccggtggaaggaacgaaggacgaactgcttgaactggcggcctacggagagtttcattccaaccatccgattgccctgtcggtgaaggacgcatatggaaagcgcgtggaggaatccaggatcgtcacggcggaagagattgccgggcacggaatccacgccgtactggatctggagaacggcagaaaagacttatatatcggtaacgaacggctgatgaaggcacagggaatcaccattacggatgtgccggaaatcatgggaacatccctctacatcgcagaaggcggcgtgttcctcggttccatcatcatatccgatacggtgcgcgaggatgtgccggaagcgctgcacggactgagaagagccggtgtcagacgtctcataatgctgaccggagacaaaccggaagtgggcagggcggttgcagataagctgagcctcgatgatgcgtacggcggcctcctgccgggggataaagtggggaaggtagaagagctcctcactacgaagccggaaggcagcacactgggattcgtgggggacggcatcaatgacgcccctgttcttgccagggcggatatcggtatcgccatgggcggaatcggttccgacgcggcagtggaagcggcggatgtggtgattatgacagatgaaccttccaaactcgtggatgccatcgttatcgccagaaaaaccatgcggattgtaaaacagaatattatatttgcaatcggtgtcaaggtgctggttttgattctaacagcatttggatttgcaaccatgtgggcggcggtattcgccgatgtgggtgtttcggtactggcgatcttaaatgccatccgggcgctgaattataagaaggcgcgggataaggcgtttgagggcagcgcaggtacggaagtttaagggaaatggccccataccttttcgggaaaaccggagggtatggggctttatttttgataaaattaaccgctgaaatttcaactgtattattttattttgacagtttctttttcgccaattctctgctacaataaaactattcatttagtgagcggaacgtcttccgttcattctgattatccggcatttcgccgatagactcactcaaacttaactgaaaattaaaaaaggagaccatgcgtatgaaaaacacagagtatctgtcgaatggtatgggcggcattgtgctgtccgcaaaggaggcgcaagacgtcctgaggacttcgcccgcctatgaggagtatttgagtctgacagaggatttcaggcgggaaatccttgatattgtcagaggagcaaaagggttaaggattacatacgacccgttttttaagcatgtatttgatcctgtgctgcatggggaacggctgtcccgtcttctgacggttatcattgggcagcaggtgacagtaaaacaggttctgccttcccagtctaagcgtctgacagctgaggcgtcgttgattatcatggatattgtcgtggaactggaatccggtgcgctggccaatgtggagattcagaaggtaggttaccgcttcccggggcagagaagcgcctgctatctttatagcgcttgacattttcagggaaatcactcacaatatagataaagagctggatgcgtggctgtattttttaagttcggatgaaccggaggacataaagcgcgtgatcgaggcgtatcctgcttttctggaactatacagggagatcgcagaatttcagaggagaccggaggagttgatagcgatgtataacgagacgctggcattgtttgataagaatacggtggagctgatgattgaagagcagcaggaagagattaagaagctggcggaagaagtcaggaataagaaggcggagctggaacagagcaaagcagatcagagagagaaggataaagaattaaggaaaagagacgaagaactggcgcggctgcggagggaaattgagcggctcggcgggaatgccggggaatgattttgctgcttactattaggagacttgagaagggagggctgtcggttgtacagtcgtccctttttgcggatgactggattattttccaaagatgaataaaatgcttccagaataagaataaaaatacattgacaaacttttttcaagctgttatattttatgcatataacgggggtgatgtaagagaatttcatcggggcggacgctccggtcaggggttctggcacatcacgcccctttttgtgtctggggatgtgctcctgctacacaaaaagccctgcgggcaggaacgcgcgccacgcttaaccgggtatgcgtgcttctgcgcgggagtccggcctgccggattctttgttgtgcagaagtgagtaagaagagaggaaagggagacgctattatgagcaaatacagtaaggaagatatcttccgaatcgtggaagaggaagatgtggagtttatccggcttcaattcactgacatttttggtatgctgaaaaatgttgccatcacatcgagccagctgaagaaggcgctcgataaccgctgcatgtttgacgggtcctcaatcgagggctttgtgcggatcgaggaatccgatatgtatttatatccggatctggatacctttgagatttttccgtggcgcccgcagcagggaaaggtggcgcggctgatgtgtgacgtctaccgtcccaataagactccgtttgagggggatccgcggtatgtgctgagaagcgtgctaaaggaagcggccgatatgggggttgtctttaacgccggaccggaatgcgaattttttatttttcagacagacgaggaaggacgaccgacgacggagacccaagaaatggccgggtacttcgacgtggctcctattgatcagggagagaatgtccgccgggatatcgtgctcaatctggaggatatgggatttatgatagaggcctctcaccacgagatggcgccgggacagcatgaaatcgacttcgaatacgcggaagggctggtgacggccgacaatgtcatgacgtttaagatggcagtaaaagcgattgcgaaacgccacggccttcatgccacatttatgccgaagccgaaggcgggagtcaatggatcgggtatgcatttaaatatgtccctgtctgatttaaatggaaagaacttatttgaggatgaggcggatccgctggggctcagccagctcgcctaccagtttatggccggcatcctctgccatatgaaggagatgaccattttaacgaatccgctggtgaattcctacaagcggctcgtacccgggtacgacgcgcccatctatatcgcgtggtctgcaaaggcaaaccgcagtccgctgattcggattccgtcgtcgagaggagagagcacccggatcgagctgcgctgcccggacccttccgtcaatccgtatctggcgctggcggcctgcctggcggctggcctggacgggattaaaaaaggtatggttccgcccgacagtgtggatactaatatttataccatggcgccggaggaggttcttgcgcgcggtatatccaggcttcctgagacgctcggtgaggccatcgaggaatttaagagcagcgaattcatgaaagaggttctgggagagcatatttataccaagtatctggaggccaaggaagccgaatggcggatgttccgggcgtacgtaacggattgggagacaaaggagtacttgtataagtattgattttttgtttcgcagctgattcgataccctggaggtgagtgcgcttggccaatgtgattgtggcgttctccaaaccggaggacgcgaaaaatattaggaatatccttgcaaaaaatggcttttcggtcgcgtcggtctgtacttccggcgcacaggccattaacagcgccgatgaactgggaagcgggattgtggtatgcggggccagatttgcagacatggtgtacgaggaactccacgactgtctgccgccgggagtccggatgcttttggtggcatcgccgggactctggaacggaagagcgccggaggatgtggtctgtctcggactgcccctgaaggttcacgatctgatcagcactctggagatgatgatggaatcgctggtcaggagaaggagaaaacagagactgaagcccctggaacggagcagggaagaacaggaattaatcaaacaggcgaaggaacttctgatggacagaaaccatatgaccgagacggatgcccaccgctatctgcagaaatgcagcatggacagcggcaccaacatggtggaaaccgcgcagatgatcatgagcctgattaacagataagggggataccatgaagtttacaaagatgcagggaacgggtaacgactacgtgtatatcaactgttttgaggagacggtggagcggccggaggagctggcggtgaaggtcagtgaccgccattttggaatcggttcggatggcctgattctgatctgcccttccgggcaggcggactgccgcatgaagatgtttaatgccgacggctccgagagcgagatgtgcggaaacggaatccggtgtgtggggaaatacgtgtacgaccaccatatcgtggaaaaggatgaattcgatgtggagacgaaggcgggaatcaagcatttaaaggtcactgacgagggcggtaaggccgtgctcatcaccgtggatatggggattcccgaggtgacgggagaggtgccggagccgatcacgatcgacggccggtcctatgaattcatcggaatctccatgggaaatcctcacgccatctattatatggacgagattgacggactggatttagaggccatgggaccggcgtttgagacacatgaacgtttcccggaacggaccaactcagagtttatccaggtgattgacagaagccatctccgcatgcgtgtgtgggagcgcggaagcggggagacgtgggcctgcggcacgggagcgacggcgagcgctgtagcttccgtcttaagcggcaggacggagaataccgtggaggtggaactgaaagggggaatattaagcattacctgggaccgggagagcggccatgtgtatatgaccggaccggccgtggaagtatttcagggggaatttgatccagaaaatttataatatgctcacaggaggacatcgatggtaaaagtaaatgacaactatctgaaactgccgggaagctacctgttttccgctatcgcaaaaaaggtgaacgcctatactgctgcaaatccggataagaagattatccgtctgggaatcggcgacgtcacgcagcccattgcgccggctctcataaaggcgcttcacgatgctgtggaggagatgggcagtgcagagacatttcatggttacgcgccggatctgggctatggctttttgcgggaggccatcgcggctggcgattacgcggcccgtggatgcaagatcgaggcggatgaaatcttcatctccgacggtgcgaaatgcgactgcggcaatatccaggagattttcagcgaggacgcggtaattgccgtctgcgatccggtctatccggtttacgtggattccaacgtcatggccggcagaaccggggagtatgacgagaagacgggaaaatggagcagagtcatttacatgccgtgcacggcggaaaaccagtttgttccggagcttccggaggagactcccgatctgatctatctgtgcgttccaaacaatccaaccggaacgacgcttacgagagaccagcttaaggtgtgggtcgactatgccaacagaacgggagccgtgatcctttacgacgcggcttatgaggcttatatcgcagagccgtcggttccacactccatcttcgagatcgacggggccagaacgtgtgccatagagttccgttccttctcgaaaaacgccggctttaccggcgtgcgtctgggctttaccgtgattccgaaggaactggtccgcggaagcgtcatgctccattccctgtgggcgaggcgccacggaacgaagttcaacggcgccccctatatcgttcagaaggccggtgaggcggtatactctccggaaggcagagagcagctaaaggagcaggtggcctattatatgagaaatgcgaaggtaatctatgaggggctgaaggaaatcggatgcgaggtgtacggcggtgtcaacgccccctatatctggcttttagtccctggcggaatgacctcctgggagttcttcgactgcctcttaaacgaggccggcgtggtgggaactcctggaagcggatttgggcccagcggtgagggatacttccgtttaacggcattcggcacgtatgagaacacggtggaggccgtggaacgcatgaaaaatatggtttccctaagaaaataacgttgacaaccgctctttctgtggttatgatagatgagaaataagaaaataaagataatggttgtgaataaaaaggacaaaagcgttcgtaccctggtggtactgacgctttttttatttcataggaaagttcctcctatgaaataaaaaccctccgggaggatgcgcactccgcgctaaggaagtatggccgctgaagcgaccgcgctccggcgcgagagtccggctcgccggactctttcttgttttacggggtgccccgcttgccggaatttttattctataaaaggagagaaaaatcagatggatgagatcgataagaaaatattgcagatgctgcaggaaaatgcaaggtattccctcaaaaagattgctgagagtacctttctgtcttcgccggcggtttcctccaggattggaaaactggaacgggaggacatcatcaccgggtaccacgcggcggtggatccggttaagctgggatatcacatcacggcatatgtaaatctggatgttctgcctggagagaagctgggattttacgaacgtatggcggagatccccaatgtgctggagtgcagctgcgtgacgggagactactccatgctgctgaaggtggccttccggagcaccatggagctggacgcttttatcggagaagtgcagaaatacgggaagacgaacacacagatcgtactgtcaactccggtcggtccgaggggggcggatggtatggaggccggcgattcctttcttcaatcgattaattattaattatagtgcatttttataaaaagtattgtaccttttctgaagcttttgtataatgtagctaaaggtatcaggctgacagggatgcgttttcagcagggaggagcagaatgagaagatacaatattaattctgactggaaattcagaaaaggtgatggaagccctgccgccgtggttactctgcctcacatctgggatatcaggggaggacagaatgggaacggcggctatgtgggagtgtgcgtctatgaaaagcagattgagatgtcggatgactggaaaggcagggacatctatctggagataggcgctgcgggcagtgtcgccgaggttgtggtcaatgatcagccggtagggacgcataagggcggctactccttattccggtttaacattacggaatggatgagacctgggcagtgcaaccgggttgaagtgcgggtggacaattccgtgcgcgacgatgtatatccgatcgccgcggactacacgtttttcggcggtatttaccgggatgtcaatctggtggtggcggatgcgtcgagattcagcctggatgacgacggctccgagggtgtttatatcattccggagattacgggcggcggcagaggacgggtccgcgtgtacagcgtggtggacgagccggaggggtgcgaggtctgctgccaggtgctggatcaggacggggagttgtgtgcgaaagcgacggtcaaggcaggaaaggagccggcagagctttttatcgagcagcctgttttgtggaatggacgcagtagtgcttatcagtacacgctgtccgcagatttgctgaaggacggaaagtggatggagaagcggatgatccgattcggcttccggagcatcagcctttccgcagaaaggggttttcagctgaacggagagaggctgtttctccacggggtggggcgccatcaggaccgggaggaccgcggatgggccatttcccgggaggacatggaggaggacatggccctcttaaaggaaatcggcgccaataccgtaaggctggcccactatcagcacgctccttatttttatgagctgtgcgaccgggaggggctggcagtatgggcggagattccgtttatctccagactctcagacagtgcagcggccagagaaaacgctcttttacagctgagggagctgataaaacagaactacaaccatccgtccatctgcttctggggaatcggcaacgatgtgaccatgttcggcgcagaggactgggtggaggaggcgcttcgggagatgaacgcattggcgaaacgcctcgaccccggacgcatcacggtctgctcccacatgatgacgcttgcggaggacagccctttgagcgccattaccgacggaatcggctataatgtctattacggatggtatgtgggggaatgcagtgacatgggagtatggctggatgaactgcagcagaagcaggtgcctgttccgatcgccatatcggaatacggcgcggatggaattctgacttaccagaccggttcgccgacgagaggcgattactccgagagctaccagtctctgtaccacgaagagatgctggcaatcataagggagcatccgctggtgtgggcgtcttatgtgtggaatctttgtgatttcgcctccgtcaaccgcaaggaaggcggtgtgaacgggagaaataataaggggctggtcacgtatgaccgaaagacgagaaaggacgcattctacctgtacaaggcggagtggtccggggagcctgtagttcatattaccgggaagcgttataagagacgggcggaaagcaggaacaccatccgtgtttattcaaacgcggaggacgtggagctgtttgtgaacagcaaatccatgggagccatgtgcaaggactgccatatcttctggctggacggggtggcgctgcttccggggaagaatgatattctggtgaagacggagcgcggggattacgacgatgtgatcctgtatggagaacaggcggatgaaccttcctatttattcagacaggaccggaatgcggagatgcgggaggtggcgaccgagtaccgtgtgaggaacgggtaccattccgtatacgatacactggatgagattttggataatccggaggcgaaaaaggttttggaggaggaggcgggagccgatgtgttgagccagcccctgctgcataccctgggagagcttccgttagaaagcattgcaaggaaatcaggaggactcatacgcaaggaatgggttgtccggctgaatgaacgccttacaaaagtgaagaaactacaggaatagatcaaaaatggtacattcagggctcttttcacatactttacatcatagaggtatgtgaaaggagtttttcttttggctgaaagaaagatagtagtgatagatgccggtcacggcggcgctgatccaggcgcaaaatttgaaggaagacaggaaaaggacgatgcattgaggcttgccctggcggtaggaaaaattctgtcggagaatggagtagacgtcagatatacaagaacagatgatacgtataatacgcctctggaaaaggccacaatggcgaatgaggcgggagcggactatttcgtatcgattcaccggaatgccatgccgataccgggcagcgcctccggagttatgagtctcgtatttgagaataagggagttccggcccagcttgcgaacaatatcaacgaagagctggccaatacggggtttgccaacctgggcatcatcgagaggccggggctggtcgtgcttcgcagaaccgagatgccagccgttctggtggaggtgggattcatcgacaatgaggccgacaaccagctgtttgatgataatttcgatgccatcgcaagagcgattgccgacggaattctgacaacgatccgggaaggggaagcggagcagccggagtactaccagattcagacgggagcttaccgtatccgctctctggcagaacagcagatgaacacactgcggtcccagggattcccggcctttatcgtcagtgaggacggtctattcaaggtacgtgccggcgctttccgggagctggataacgccgtgcaaatggagcaggagctgagacggtatggatacaatacatttcttgtcagaagaccggcagtttcctaagagaccggaccgggaccattttccagcggtgaaaatggtcccgttaccgacatggctgtgaactataatatgaccccgctggggaactccatattccggaaaaatagtgtccgcggcagaaaatgtgtgttataatggagacagaaaacaacaaatcaacggtcacgcatgcacaggagggattcacatgggagataagaaacttgttattaccattggccgtcagtatggcagcggcggcaatgaaatcggtcggaagttggcgggagaactgggaattgatttttacgacaagaatatcctgcgtatgaattccgacgagagcggcatcaaggagagttactttcatctggcggatgagaaagcggggaaccggcttctgtaccggattatcagcagcatgacgccggagatgagaggccccagcttcggttcggacctgatatcggcggacaacttattccgtttccagtcggaggtgatccggaagctggcagaggagcagtcctgcgtcattgtgggccggtgcgccgattacgtgctggaggacgcggacaacatcgaactggtgcggatcttcatttattcggatatggacgcgagaatccgcagggtaaaggagaaagaactctatgcgccggaggacattaagaagaatgtgaagcggattgacaaggaacgccggaattactaccgttattacacggggagaggatgggcggacccggagaactacgatcttctgatcaatacatcaacggccggaattaagggaagtgtcagaatgatcgaggagtacataaagatcagaggctataaaatatgagttcgggcggcacagtcaggtttggctgtgccgtttttttgacggctgaacaggataaacctgtaaacttacagaattattaagaagtgtggttcctaatgaggttgagagcgagttcagggggggcgttccgccaggaaaccggggccggagtgcttcacccagtttcagatcggtgaaagcagcttttcataattctgtaggtttaccctgatggctaaaaatgatatattgtgaaaacctgcagtagtgtgatatgatagagccatccgggcaggccggacttgcgaaaaggcgcctgggaatgcttattatggaaatactggtaacacaggataagggacaggagagaggaaacacatggttaaggcagtgatttttgacatggatggcgtgatcatcgacagtgagggaacgtatttggaatttcagctggaatttgccaggaagaagaacccgaacgtgcgcatcgaacaactttatccgatggttggcgcgacgaaaaaagaggcgtgggaggtactggagcgtgcggtcgataacggacagccgtgggaggaattgagagatgagtgccgccagcgtgatatttacagtgaggtggattacagagagatctaccgcccggaagttacagaggtcttaagaactttgaaggaaaagggataccggctcgccctggcttcttccacccagctggacttagtggaacgggtccttcgtgaaaatgagatccgggaatattttgaagtggtggtcagcggcagccagtttaaacggagcaaaccggaccctgaaatctatcagtatacagcggctcagctgggcgtaaggacggaagagtgtctggcggtggaggattccaccatcgggatcacagcggccagcagagccgggatgaagatcgcggcggtgatcgataaccgctacaatttcgaccagagtctggctgattatcacattgccagggtgaaagaggtattagaagtggtggatgaagcataaaatacgatatacaaccttgaaggaggaatgatttggagtatatcggtgaattactgaaaggcgtggtcataggaattgccaacatccttcccggcatcagcggcgggatgctggccatatccatgggcgtgtacgacacgatcatccatgcggtgaaccggctctttaaggaaccggtggaaagcataaaaacgctgtttccctacggtctgggggcggtggctgggatcatcagcctgtctctggtgttcgaatacttatttgggacatttcccttacagacgaagctggcgtttatcgggcttatcggcggcggccttccggccctgtttgagaagacgaaggcgaaggcggagcctggggagaagagactgggggcggtgacgatctgcatcacagccgccgtggtgatcttcattaccgtagcgggcggaatatccctcgcctccggttcccgggctggaggcgaggcggtgaagaccggagcggcctatctctcttccggccggttctggatcatctccatgttcttcgtgggcatactggctgcgggaaccatggtggttccgggcgtgagcggctccatgatcatgatgatgatcggtgtgtacgagccgctgctgcagacgacaaacggctgtatcagggcggcggccgcgtttgattttccagcgcttctgtccgatggactggtcctgcttccgtattttacagggctgggactcggaatttttctgtttgccaaaattgtggaacatcttctggtcaatcatgagcgccagatgtaccgcgtgatcatcggcctggtattttcctcgccggtggtgatcctgtgggatgtggcgtggaaacagatcgaactctaccagctgcttggcgggatttccctgtgcatgctgggatacgtggcggcggttcggtgcggcggagaaggatgagccggcggttgaggaacgggaatacaaaaaacaggaatacaaaaaacagcaatacaaaaagccagatgcatcgtctgatcagcagaaccgatgcatctggctttttttgtttcttcttattatattaattaatttaactcggcaattcttgtgactcccacataaatatgggatattttataccaggtgcggaaatcgatgactcccgttaccgggaggccgaatatggactggaattcccgcacagcggcggcggttgccggtccgaagattccatccggcgtaatgtgcgggatggcgctgtagacggtggcgatggcgtccagctgttcctgcacctgctgtaccttctggccgctggagccgatggttaaatcgtagccgggccaggaagcggggatgccggaaatctgctcggcggtattgatgtacatgtcatcaccgtagaaatagcgcagaatttcaatggggctgtatccgcgctcgcctaagtcggcggagccccactgggtcatccagcctttgtgctggcaggacacccggttgccgtcacagtactgggttaagatcggctgtttgacctcgggacgcgataagtagttgtcgaaaatctcatccacaacctcggagatggactggaagatatttctgccgtagatccatttatggtcaaaagcggtggaagaggtaatggtgaaatcgtagccctggttgcggtaccactccgtgtagacacggttcagtgtgaagctcatgatggccagaacgtttgccgtgatggaggagcggggccaggtggcataaatttcactggaggccacattcttgatgtagtcccggtatggaacgtagtaattgggggcggttgagtcggtaggaaccccgtcatgaaccacgacggtctgaggaactaccacgcggcttaagacgatctcaccggtttcagccaccggctttacttcagcttcagcaattttcggcggatagtagccatagagcgtgtgatccggaatgacgatgggagtgtccggtgatacctcgtcggccagcggcgtcatacggaccggctggattgcaagagagtccggcaggatttccgttcccgagatagcgacttccgcaaagccccgcgcccggatggtgatggtatattcggaatagggctgggttaagccgggcgacaggctgtattccagcggaggagcggctaagcggatctccccggtctggccggaagaattggtgttcgtcgattctacagtgctttcaggatctcctttgtaagcgatggaaacttcggcatcgcggataggaaaattgttttcggcagaaactacatttacctggagtaagccggtatcagtaggttccagtgcggcagcggtcatatattttctcatagattgcccctttattggatgattactgacagtatatgacggctgtctcgcaaatgttccggtttttccggaaaacgggctgcggcggagaaagtttctgccgggagggggcaggcgccgcagaccgggaatcctggctgactgaagggattccgaatttccggacgttttaccggaacatggactctacgtagttacgcatttcattccggctctcaacgtttctggctccgtctgcgagttcgttccgtctggattccggaagctctgcaaaacgggtcagaatgtcggaatgctgtgccagctccatggtaaagccgatgggcatttcactgttatctatcataaacatcacctcgcagatagtctctgcagttttgaaccaggttattcgtcgggaatgcgattccttaaggaggtgaatgccacggccggaagaaccatccatctcaatatataaaacagggtattgtataatatgtttaaaatagtctgtgaaaaacggaaaaagatagtcaggcaatcgtgcagaaaacagttgaaaaatgtcgtgaaatcatgtataatctattcaatttgggctgattttcagagcgctcaaacaacgcatagcattaagaaaggattgggactttacgtatgaaagcttttttaatactggaagacggaaccgtattcacagggaccagcattggttcgaaaagggaagtaatcagcgaaatcgtatttaatacttccatgaccggttatttagaagtcctcaccgacccctcgtacgcggggcaggccgtggtgatgacgtatccgctgattggtaattacggaatttgtcgtgaagatatggaatcgtataaagcatggccggacggctacattgtcagagaattatctagaatccccagcaacttcagaagcggggataccattcagcatttcttagaggaacaagatattccaggtatcagtggtatcgatacgagagccctaacaaaaatcttaagagaaaaaggtacgatgaacggcatgattacaaccaatgaaaattttgattgtgatgaggctgttgcccgtatgaaaaattattcggttaccggtgtggtgaagaaaaccacctgcgccgaaaaatacgtgcttccgggagacggaaagaaggtggcgcttctcgatttaggcgccaagatgaacattgcccgttctttgaatgagagaggatgccaggttaccgtatacccggcgacgacggccgcggaagagattctggcggaaaagcctgacggaatcatgctttccaacggccccggagatccaaaggagtgtacggatattatcaccgagatccgcaaattatatgaatcagaggttccgatctttgccatctgcctcggccatcagctgatggcgctggccacaggcgcggacacccacaagttaaaatacggtcaccgcggcggaaaccatccggtgaaggacttagagacaggacgcgtctacatctcgtcacagaaccacggctatgtggtggacatggatacgcttaaagctgagacagccgttccggcatttgtcaatgtcaacgatggcaccaacgagggattaaaatacgtaaataagaacattttcacggttcagtaccatccggaggcatgtccgggaccgctggactccggctacttatttgacagatttttgaaaatgatggaggagggaaagtaatgccgaagaatcctgatattaaaaaagtacttgttctcggctccggcccgatcatcatcggccaggcggcggaattcgactatgcgggaacccaggcgtgccgttctttaaaagaggaaggcatcgaggtggttctcttaaactccaatccggccaccatcatgacggataaggatattgcggacagggtttatatcgaacctctgacggtagaagtggtggaacagctgatcctgaaggagaaaccggacagcgtgctcccgactctgggcggccaggcgggactgaatcttgccatggaattagaggacgccggattttttaaggataacaacgtgcgtctgatcggaaccacggctctcaccatcaaaaaggcggaagaccgcgagatgtttaaggagactatggagaagatcggcgagccggtggctccctccgatatcgtggaggatgtcaaacacggtctggaaatcgcggaaaagatcggttatcccgtagtccttcgtccggcttacacactgggcggttctggcggcggtatcgcagagaacccggaaaaatgtgcggagatcctggaaaacggccttcgtctgtcccgggtaggacaggtcctggtggagcgatgcatcgcaggatggaaggaagtcgaatacgaagtgatgcgcgacggtgcggacaatgtgatcaccgtttgtaatatggaaaatatcgatccggtcggcgttcacaccggcgacagcatcgttgtggctccctcccagactctgggcgataaggagtaccagatgcttcgtacatcagctcttaaaattatcagcgaactgggaatcaccggcggctgtaacgtacagtacgccttaaacccggacagctttgaatactgtgtcatcgaggtaaacccgcgcgtgagccgttcctccgcgctggcttccaaggccaccggatatccgattgccaaggttgcggccaaaatcgcgcttggctataccctggatgagattaagaacgcggttacgaagaagacgtacgccagcttcgagccgatgctggattactgcgtggtcaagatgccgcgcctcccatttgacaagttcatcagcgccaagagaacgctgggaacccagatgaaggcgaccggagaggtcatgagtatctgtacgaactttgaaggcggcttaatgaaggcgatccgttccttagagcagcatgtggacagcctgatgtcctatgattttacggagctttccgacgaggaattaaaggacacgctggccctcgtggacgacaggagaatctgggtgatcgcggaggcgttgagacgcggcttcacctatgagacgatccatgcgatcacgaagatcgacgtctggtttatcgataagctggcgatcatcgtggagatggaagaggcgcttaagaagggaccgctgacggtggatctgctgagagaagccaagagaatcgagttcccggacaacgtcatcgccagactgacaggaagctccgaacaggagattcatcagatgcgtaaggacaacaacattgtggctgcgtttaagatggtggatacgtgcgcggctgaatttgcggcggagacgccttactactattcctgctttggcagcgagaatgaagccgcatataccagcgggcggaagaaggtgcttgtcctcggttccggcccgatccgtatcggccagggaatcgagtttgacttctgttcagttcacagtacctgggcgttcagcaaagagggctatgagacgattatcgtaaataataatccggagacggtaagtaccgacttcgatattgcggataagctgtatttcgagccgctgacaccggaggatgtggagagcatcgtggacatcgagaagccggatggggcagtggttcagttcggcggccagacggccatcaagctgacggaaagtctgatgaagatgggtgttccgattctcggtacggccgcggaagatgtggatgcggcggaggaccgggagctgttcgacaagattctggaggaatgcagtattccgagacctgcgggccatacggtttacactgccgaagaggctaaagaagcggcccataagctgggatatccggtgctggtccgtccatcctatgttttgggcggccagggcatgcagatcgccatcagcgaccaggatgtggacgaatttatcggaatcatcaaccagattgcccaggagcatccgatactcgtagataagtatatcatgggaaaagagatcgaggttgatgccatctgtgatggcaccgacattctgatcccgggaatcatgcagcatatcgagaggaccggtatccattccggcgacagtatttccgtctatccggctcaggatctgacagagaagaatattgagactttagtagactatacggagaagctggcgagagcccttcacgtgaaaggcatgatcaacattcagttcattgtggacggagacgacgtgtacatcatcgaggtgaatccacgttcttcccgtaccgtgccgtatatcagcaaggttaccggaatccccatcgtgccgctggcgacgcagatcatctgcggacggaccatccgggagctgggctatacgccgggacttcagccttctgcggactatatcgccatcaagatgccagtattctcctttgaaaaaatccgcggcgccgatatcagcctcgggccggagatgaagtctaccggagagtgtctgggaattgcgaagaccttcaatgaggcgctttataaggcatttgagggggcaggcgtgcgccttccgaagtataaaaatatgattatcacggtccgcgattccgagaaggaagaggctgtggacatagcaagaagattccaggcacagggataccggattttctctaccgcgggaactgcgaagttcttaaacagccatggagtaaaggcgctggcagtaagaaagctggaacaggagtccccgaacctgctggatctgattctgggacatgagatcgatctggttatcgatatcccgccgcagggggcggataagagccgtgacggtttcataatcagaagaaatgccatcgagacaggcgtaaacgtgctgacctcactcgatacggcggcggcccttgtgaccagtatggaaaacagggcgaatgaattgacattgattgatattgcaacggtttaaagggcagacgggcggcagttacaggtttaaatatctgtggctgccgcctgtttatattgttagaggaaaaactgttttactattataatcgggataactggctgttgacagctcaaaagctatgtggtatatttgtaacataaagttataaatataccacatagaaaggagtaagaatatgaaatacggctatggttgtctgggatttttatcgctgctgggtatcctgggaattgtcacggaggagcgtaccttcctcgcattctttggatttgcggtggattttcagtactttttcagaaagacagatgagatgatgatcgagtatatgaataagtccgctgccagggcatttatgtgcggcatggttttaactgccgtggtgacgctgatttatgcggcgctttatgggatcagcaaggcgcttatcatcgggattgcctgggggtggagcgcatcggtgctggtctatgcgttatcaactgcctattacggaataaaagaaagctggtggtcgggagatgattaaaaaccggatcaaagaataccgggccaggtatgatatgaagcaggaagaactggcggccagagtgggagtccgccgtgagacgatcggcaacctggaaaaggggaagtacaatccttcccttgttctggcctggaatatcgcaaaggtcttcggcgtcacgatagaggaactatttaccgtggatgaatcgtgacgccgtttgcggcagcaccgagtcagatctctgatttgtggtatttaaagaagtccagtgtctcggcaatgtcggcctcgtctgaaaacaggccgatggcctttcccgcttcgactgcaaaatctacatatccgtttggtctggctgtgatgagacgtccgtcgctcacagccagatttttgcttgtccgaatggtgttctttccttccagaaaaccgtattcttccagaagatcgacgccggcgcagatggcgcagatacaggatttgtcccggttaagtctgtgaaggaaggcactcagttcgtctcctctgacatgagcgatatcgccgcccggaatgatgaaggatgtgacttcgtccggatcgatatcctttaaaaatgtgtctgcctgaacgcagaagccttccgatgtgcggattgttccgccgcctgcgtcatcggcggagccagccatgcagtaagcacagggctgttcaccaagcgtggaatatttcatgaaatatcccagcagcacgatctcaaagaaacagcagtcgtcataaataagaaagtagttacgcatagttccgcctccgcaataaaattgatatccttattataggtgacgccacgttatttgtatagataaattgacattctatttatttgatggtaagattaccctagatttataaagaaagggtgagaacgatgtaatggtttgtttataagtaaatcaatggaacctgggatggaacgcagcgtgcgggccgtcttgttttgatacccttataaacgatacttttacaccgtacacacgcccgaaaaagaatttctttttcgtctgttttcgtgagcggctggtcgggaggatacgtattgatcttcttccggaagctgccgcgggacttaacttgtgttgtggtgatgtatgggccacagcttttttatttcacaggaaagttcgtcctatgaaataaaagccctccggcgcgagagtccggcgagccggactctttcttgtgtaatgggagagggctcctgtctcgtaaaatggaaacgtgcgctttggcggatggctgaaaggtctgtggcatataacgggaacatgaagagagaaagaagtgaaatgaatatggaaatgatttataaatatccgagaacccgccatatcgaaggctccagaatccaggcgggcgacgaggatttgaaaaatgtgagattcgaggagatccggggaaaattcgtggtcctggaggaaaaggtggatggtgccaactgcggcgtcagctttggggagaacggtaaactgatgctccagagcaggggccatttcttaaacggcggctatggagagcgccagtttgatctgtttaagacgtgggccagctgccatcaggcggatttatatgagatgctggggacgcgctatgtgatgtatggagaatggctgtatgccaaacacacggtgtactatgaccggcttacccattattttatggaatttgacatttttgataaggaaacgaaatgctttttaagtacggctgcgcgaaggaagctgctcttacagtgcccgtttattgtgtcggtcctcgttctgtttgagggcaggctggattctctggatgagctggtttcctggcttggcaggtcacattttaagtcggagcggtatgagcagtccctgcgggagcagtgtgaggaacaggggctttattgggaactggtaaaacggcagacagacatgtccgatctcatggaaggcatctacatcaaggcagaggacgacggtctggtgacggaccggtttaaatatgtgagaagcacatttttaaacacaattctcgattcggagacgcattggctcaaccggcccgtcattccgaaccagctggcgccggggacggatttattctcggatcttccccttcgggaggaggtgtgagtatggcagatcagcagagacttgaagatttcttagagcagaaggaatactgctttgacgcactcctcgtggagtttcgatggctggaggagctggaagacgtcatgcaggacagcacatggcaccgtgagggaaatgtgctggagcatacgaggcgcgtctgccgtgcagtcgtgtcaggcgaagagtggaaggatttaaacagagaggaacgtgcggtcctttatatggccgccatgttccacgatatcggaaagaagagctgcacgatgcgctctgccgaagaagagggcagaatcatttcccccgggcacagcattgcggggatgaagcggtttcgggagctgtgctataaggaattggaggaacgttttttgattccatttgcggtcagggaggagatagcctggctgatccgttaccacgggctgccgctcttgtttatggagaaggagtcgcctgccgttagtcttgtgagagcaagggagagcgtcaggctgaggctgctctggcttcttgggcgcgcagatgtgctgggacgggagtgcagcgacaagacggcggctctggagacggtggaatatttcagggcttatgccagggaaacaggctgttatgatgagcggattcattttgctaatgagtatacgcgattctgttactttgagaaacagaccatatggccggaggaatgcctctacgatacgacgaagttcgatgtctatgtgatggcggggcttccgctggcaggtaaggatacgtatattcaggagaattttccacatctcccggtgatatccctggatgacatccgggaggagatgggagtgcggccgagtgagccttccgggcctgtggcagccgttgcgagagagcgggcaaagggatttctgcgcacgcagaccccatttgtgtggaatgcaaccaatctggtgctggacaacagacagaagatatgccggctttgcagcaattacggtgcaagagtgaatatcagatatttggaggtgccctaccgggaagtgctgcggcgcaatacggttcgggagcggagcgtgccggtggatgtgattaaccggatgatccgccggctggatatggtagagcgtaccgagggcttccgggtaagcttccagcaaaatgacggccgccggataaaatagagccggcaggccgatctgagaaaaaggagtggagagagatggtgttttacattaacaaacaggcagtggagattaagacgagattcgaaaacgcacctttgacctcgccgaatgaagcgtgtgcggcgatcggcatgctgtgcagaatatacgggcttcccataccgaaaaagcgggagatggtcagcgagatgaagcaggatctccacaccgccatcgatgggaagccgatcccgtcggaattcgcggagaaagtcttaagccttttagaagggtattttaaagatgatccggtgacagatgagatttatgagctgctgaaatacagctatgatgagcagaaatagtgttaaaatataagcggagagctgatttggggggaatagaaaataaactattataaaacagtaattttaaaagataatacaaaatgtttgctgcggaatgcgcgggaagcagatgcagagttggttcatgataattttcagcaaacacatggtgagaccgatttcctgttgacttacccggacgaaaacagtttcaatattgagcaggagaaagctattttgcttgaaaaagaaaacagcaggaatgagatcgaattatgtgcatttgtcggtgaatatttagtcgggggagctggaattgaaaaagtcggttcaaaggataaggtaaaacatcgggcagaggctggaatcagcatagcgaaggcttattggaataagggcatcggtcgtgcactcatggaagcatgcatagaatgcgcaaggcaggccggctacctgcaattggagttagaggtagtcagtaccaatgtgggcgcgatcgcactatataaaagcgtgggattcctggagtatggcaggaatcccagagggttccgttcccgcagtcagggatggcaggaaattgtgctcatgcgattagagcttgactgattaaacggggggaagtaaatcgtaattccactaataatggcaatggtcagagttctgacaatatctgcaatgcaatttcttttgcctttgagctggacacctccgcgccctcagtctcgcctaaataaacgctgaaatacacgattccgccgtgggtgtctgcgaagcctgtaaaccacgaatcgactgcaacaccagccattttgcccaatcctgtttttccatagacgggaaaaccggtttcgccctggtcagtcaccagcattacctgttttaattgccgtatagtctccgcgcggtaaacggtatccggtccgaagatccgttccatcacgtgtacctgctccgatgcggagattttcagcgaggattctatccagaagcccgtcaacgcccgattattattgtttgtgttcaggcgtccctcccagtcggagatatcacagttcccgtattgtaaccggtttagctctgtttgaaggagatccggtccgatatcatcgatcacctttctgaaataccagacgcaggaagtacgaaatgcttccggaaagtcaatgtctttgttccacgcctcgttccagaagctttccccgctccaggaacggacggagtctttgggatcgatgaagccgttttccagaccgatcagggaggagatgatcttgaatgtggaacagggagaacgctggaggctggccagttccggattgaagatcattgttttgcctgcggttggattgtagaatacagccgcgccgttcaggcctttgaaatggtgagaccagtcgggttctatgatcgacggtgcgggaggtgcggtaacggtggattcttgtgtgggggattctgtagcggtggattccggcgcggacaaaagaccattttcctctatactttccctatttgactgtcctaaggcctcagtcccgttcgcctcctgctccaccatttcataaggcggagtgctctcctgaaaattcttcataccagagcacccggacagggaagttaaacatagtacggacagaatgccgctgattctatagatacgtctgattcttcttatggtcatatttgttcctccggatttgtttcactgcgtttgctttaccacatttgcttctacagagaaagttttttataacaaaaaaatgctgacctcccatttaggaaatcagcaatctcttctaatggagatgacagggctcgaacctgcgacttcttgcgtgtgatgcaagcgctctcccagctgagctacacctccatagcaactattttaccacgttgacggaaaaatgcaagaaaaaaatggaaaattaatcataatttatcctgtaaaaacacaattgagcggcggaatcgttcccgccgctctgtgttattgcgcagtctttatttctttacaaactgcttatcgaattccggattgaaatagtagaaattcttggaatccagattggacttaatcttctccagcgcctcgccgaatctctggaaatgaaccacttcacgttcacgcaggaacttgagcggttccctgacttccggattgtcgatgatacggatcaggttgtcgtaggtggttctggccttctgctcggctgccaggtcctccgttaaatcggtgatggcgtcgcctttggactggaactcacaggcattaaacgggacacctgctgcggcggtcggccacagagctgtggtgtgatcgacgtagtaggcgtcaaagccagcagtctttacctgctccggcgttaaatttttcgtcagctggtagacgatagcgcagatcatctccagatgggccagctcctccgtaccgatatccgttaaaagtccgccaacttccttgcatggcatggagtaacgttgggaaagatatctcatggaagcagccagctctccatcaggaccaccgaactgggtgatgatgagagatgccgtcttcgggcatggcgtcgaaatttttactggaaactgaagccgtttttcataattccacattagacagtacctccttcccacggaagcggaccgtcagaccaggtaaaatgcttctgtcccggatacttcgtatgggtttctgatttgttattggtatcggggcagacacagtcaaccgtcagcggttcaaaattctccgcgtacgtctgcatcagctgttttctctgcttcatggcgtcgctgaatgcctttaaagcgttgtcgtcaagaggatgggtgtcaaggaacagggtcagatcattgactgtgaagctgatttcattaatctgttttaacatcgtttcgcggtctgccattatttgccacctccagtcacataaaacggtaagtcgagacaagggaagatcgttccgtgctgtaaagcggcagcaggctcatatggctgctcccagggctgcatcggtactgtcgcgatagccagtgttaaagcggcggcaggtgtactcttgtcactgccggattttccgcagccacatgaactgtttgaatttaaattcataagaacactcctttcatgttgcattgtaaagtatcttctcttctagtatctgcccggaagataaaaatacgatgcaaaaaatatgccagaataaccaattgccttattgtataatggaccagaataaaatataatggtagatatcactaggataacaggagatcagaacattgaatgacaagaaatttgcagtattaatcgattcggataacatttcagcaaagtacatcagctatattctggctgagatgacaaagtatggtgtcattacatacaaaaggatatatggagactggacgagctctcagatgggaaagtggaaacaggaactcctggaaaattcaattacaccgattcagcagttttccaataccgtgggaaagaatgccaccgactctgcgctgattatcgatgccatggatttgctgtataccgataacgtggatggattctgtattgtttcgagtgacagcgattttacgaagctggccagcagactcagagagtcaggcaaagaagtaatcggtatgggagaggataaaacgccgaaatcattccgtgcagcctgtaccgtatttactaatttagagatcctgcttgaccaggatgatgagagcgtaagcggagtaacggtaggacgggaagtcatcgaacaggatatcgcctctattatactggagaacgacgatatgaataaggctactggtctgggagaaatcgggaatcgtcttgtaaaaaaatattctgatttcgatgtcagaagctatggttacagctctctatcgaaatttctggaggaaatggatagttttgaactgaagaaatcaaataatgtagtgacggttcgcataaaggacaaccgcaccaggaaacaggagctggatgattacgccataaagctggtgagaaacagcggaaagaacggcctggagctggcagctctgggcaacggcatgcacaggaagtatggggatttcaaggtcaaggattacggctactccacattttccaagtttgtgcagagtatcagccagttagaggtccgggaaaataagacaaacaacaaagtcgtcttcatcagacaggagtaatacggaaggaaagagggaataacgatggtacgttacagctttggtacaaggctgaccagactttccgacggagagagacgagagggtgatgacgcctgcattacggttatgacgctggaggagttccgggaggcgaaggagacgtaccttcaccggaaggtactggtgcattccatggagaatatccattactgcaaggcggaggcgtacggcggctgcacgatggggacttttatgattcccaacaagaataatcttttgggagaaaagttttccttcggcttctatgtgacggacagtgagctgattctgctcgacgaaggggatatgctgactgagattatcaaacggatggaggacattgcgtcgaaagaagggactgtccatgcccatgctggagaggagagggcgaaggaaaaagggatgcctgccgctcccgcggagtttctgatcctcttaatggattatctgatccgcaacgatgtgcttttcctgcagaagtatgaggcgaagctggaggacatggaggacgagctgctggatcatcagccgaagaatttttatgaaacggtgatcgtgagcagaaaggaactgcttgcactgcacacctactatgaacagctgatctctcttggagaggaactggagtccaatgacaaccacctgttttccgaaggggaatgcgccggtttcggcatgttcgccagccgggccagccgccttcacgatcatgtggaaatgctgcgggagtatgtatttcagattcgggagatgtaccagtctcagattgcctccaatcagaatcagatcatgagctggctgaccgtggtgacgacgatctttctgcctctcagcctgttggtaggctggtacggcatgaattttgccaatatgccggagcttcgctggaaatacggctacgcagggatgattctcctgagcgtcgtaattgtggcggtcgagatttggttttttaaaaaaaagaagatactataggagaacgcgatggaaaacaaggaaaaaggctcgtttgtcggcagtgtgcttctgtcttccccggtgtgggatgcagaaaagttaaaaaaggatttgctggatgagtggaacatcagcgtaccggacgaggaggagacggataacgacaccatcgtattcgaggcagataattatatggtagctatcagcctgatgccggcacccgtgcctgcgggagaggcggagtattacgccaagtccaattatttctggaaaggcgctgtggacgcggccagtgagcaccgggcccatatcctggctgccgtggtcgggggaagggaaaatgatccgtttgcagccggcaagctttacgtaaagatttcttcggcctgcttaaagcaggagaatgcgctggggatttataccagcggaaccgtgtttgcgccggagatgtactgcgccgtggcggaagatatgaaagaggaagaagagacgtatccgattttagactggatttattttggcctgtatcagacggaaaaagggatgaacgggtatacatacggcatgactgcttttgggaaggatgagatcgaggtgttggaaagcgcggctgcgccagccgagcttcacgaattcctctttgatattgcgagctacgtgctctgtgatgatgtgcttttaaaggatggagagaccatcggcttcacggaagacgagaagcttccgatcaccaggtcgaaaggcgaggcggtggaaggcgacagcataaagatcgccttcatgcctgcttaagaaatcaggaaccgcttaccagatgcccagaaagctctgcatggacaggctgaccagggaaatcccgatccagcagcacaggcccagaagaatcggtttcattcctgtttttacgagggtgaccaggttggtattggtcccgatggcggccatggccatgatgatgaagaatttgcttaaatctttcaacggtcccgtaaccgtggcggggagatgaaatacggtggtcagtacggatgcgagaaggaagaacagaacgaaaaacggaaatatttttgcgatttgaaaggtatttccggagccgctctgttctttttttgtgcggtaaaatgccaggaacagagtgattggtataatcgccagggttctggttagcttaacaatggcggcggcctccagcgtattgcttccgtagatgccatcccatggggcagcagcggccgtgacggaggaggtatcattgatggcggtgccggcaaacagcccgaagccctcgttggaaagacctaaagcggtgccgagtgcggggaaaattaatgcggcggcaatgttgaacaggaagataacggagatggactgtgcgatctcctcatcgtctgcctcgatgaccggcgcagttgcggctatggcagaaccgccgcagatggaggaaccgacgccgattaagatggcgctcttcgtcggaatcttcaagagccggaagagcagaaccgcgatgagaattgatgtggtgatggtggccaggatgatggggagagactgccttcccttttccagaaccacggataagttcatgccgaagccgagtaaaacgacggcgtactggaggattttctttgatgtaaacgcgattccggggcggaaacgctcctttccctttataaatggggcaatagccattccgattaagatggcgcagacggggccgcccactaccggaaagagtctgcctaaaaaccaggctggaatggagatggcgagacagatcagaagccctgcggtatattttttcatagttaaaaattcctttcctgttcgatatcattatgagatcatggggataaatttattccagcgggcaacgggttaaacgcatgcctgcatgaaaatttgactgaccatggaaactgttaccattatacagaaggataaccataaaataaaattctaaatatttatttattgataaatatatgttatgatataggaaaaggaacgtattttacaaaaggaggaaagttcagatgctggattttcggatggatacatttctcgccgtatgcagatgcatgaattttacaaaggcggcggaggaattgaacataacacagcctgctgtgtcgcaccatattcactatctggaggaacactatcaggtaaagctgtttgagtacagcggtaagaagatcggacttacggaggcggggaagatgcttctgtcggcggcgacgacgatgcagcacgacgagcttcatttaaagcaggcgctcaagatgtcggatggtggcgggcgtcgtctcgtgttcggggcgaccatgactgtgggagagtacgttctcccggaagcactgatgcggcttatggacgcccagccggatatttctgtgaaaatggtggtggccgacacccaggatctgctgcggagccttgacgagggggagatcgaatttgcagtggtggagggcttttttcaaaaaaaggaatacgattttctcgtctacgacagagggaaatttgtgatcgtggcttcgccggaataccagtttcacagcgagggaaaggtgatcgaggatctgacgcaggaacggttctttatccgggagccgggatccggaaccagatatgtgttcgagcggtatctggaaggcaagaaccttctgattcacgattttgaggacctgatggagatcagcaacattggcgctatcaagagcctggtggcagatggacggggaatcacatttttatatgaggccgctgtgaagaaggaactggaagatggccggttgagacgcgtggcgctggaagactttgagctcagccacgattttacttttatatggagaaaagacagcatttactccgaatattaccgtgaactgtaccgtctgctccggggagaatgacggatagtctctgctttatcgaaaacactcttgacagaattaactgtatctgttattgttacagtgtaaactgaaatgataaaagttacagtttgctgcggaatgcagtaaagtgtgtgaaatggagtgataaagatgaagagaggcagatcgaggagacgccgccgtcaggccaggctggtgatgtacggtggaacggtcattttactggctgcggttcttggaacggcaggtctggctgttgggcggagatccggcggcagaaggccggaatccgcagtggaagagagcagcacggcctctgtggcggaacatctggcagggacggtaacggcttacgaaggcacagtcgccgaggggattgacattactggaaagagccggagcgacgccgagaagcttcttttggagaagacgaaggggctgtctgtgatctggcaggatgagaccgtgacggcggaggaggaaaccggcggagcggtcaggaggattctggatgagatttacggaaacggacagatgaaaaccggaacattcagtttcgacatggattctctggaggagtccttcggtgcgctggctaaggagcttgccgggaaatggaaccgtgcggcagccgattcccagctggcctcctttgataaggaaacaggcgtctatacctattcggaggcgaaagctggaagaacgctgaatgaagaagcgctggtacagggcctgatggaggcggtgaaagctggaaattatgctgcggtgaatccggaattttcggagatatccccgaaacgcagcgcggcgcaggcaaaggagcagtatcaggttatcggaagctttacgacgaagacgacaagcaacaaaaaccggaatgagaatattcgtctggcggtggaagcgatcgacggcaggattttgaagccgggtgaggaattttcctttaatctcgccactggaaacaggacgaaggagaagggataccagcctgccggagcataccggaacggcgtgctgattgaagaaccgggcggcggcgtgtgccaggtgtctaccacgctttataatgccattgtgagttcagggctttcggcgacggaacgccattcccacagctttactccgagttacatacagccgggagaggatgccatggtaagctttgacggctatgccggaccggaccttaagtttgtaaattcagagccgacaacggtggcagtccgtgcctctctgaaggataacacactgaagatctccatagtgggccttccgattctggaagatggcgtgaaggttaccatgcgttccgaaaaggtaagggacgtagaaccaccggctccggtgtatgaggccaatgacgggcttcaggcaggtacggagaaggttgtggatcagggccagaaaggcggagtctggaagaccttccgcgtagtgaccaaagacggcaatgtcttggaagagactccgcttcacaatacgacataccgcggaaaggcatcggtaattcaaaagaacgagaacgcggcagaaaccggtgagtcttcggcggaggcgggagcaaacgagagcgcggccggcggacagacgcaggagagtgctggacagggaaatgccggggaggaaagtgccgggcagggaagtactggacaggaaaatgccgggcagggaaacgcaggccagacgagtggcgccggagatgcagcaggtggaaacgcagggcaggaggaggcacagcagcaggcagttccccagcagacaccggcggcaggtgcagatgcagtcgtggtaccggcttttccgggtacatgaatttaagatatgttgaaaataaactataaaataaaaccattaaatgtcatttggaataagaaaagccttttagagactgatcttatccccaatggcatttttgttttatttgctgaaggccatctcgatttagttacaggattttactaatcgtaccaatacactgtataataattattataataataaaaagcaatatgcaatataaataaaaatataatattaaaataatatatattgacatatcacacaaaatatagtattttattattataaaaataataattaagaggaggaagcaaaatgaaaaaaagtatttttatgatctcgatgatattaatactttgtcttacagcatgcggacagcagaaggacgttccaaaagagagtggtactacaagtgaaactgcaaaatcaggtaaactgaatgtattgttcatgtcgggtgtttacgcagactcagcacgatccatgacagatgagttcaaagaaaaaacagggttcgacgtagaagtcaatgatgttccgtttgcctcattccatgagactgccatgctggactttgccagtcaggcgggaagctacgatgttgttgcggtcaatttatcatggctgggagaatttgctcctcatctggaacctttagatgaccgggtaaaggagagcggaatggaagtagataagtttatacccagtgtctacgatgcctgtaaatggaacgatgtgctgtacggatttccaaaggcaccgacaccgaacatgatggcataccgcacggatctgattgatacgccgccaaagacatacgaagagtatatgcagatggcggagaaattcaatgatccggacaatggaatgtacgggatctccataccgggaaagaaagagcagtatgcggttctctaccttgtacgttcatgggccatgggagcagacgttgcggacaaagactggaatgttgtggtaaacggtgaagtcggacgcagtgccatggagcagttgggagaagttacaaagtattccgatccggctggtttgtcatggggactggaggaatccatcaatgccttccttcagggaaaagcagcattctgtgaggcatggccgactctgggaatcgtacaggcggcggatgatccggaaaaatccaagattgtggataactgggctatcgcaccattccctcaggaaaagacaggaatcaaccagatgagtatctggtgtgtggctgtttccaagtattcaaagaataaagatgcggcattccagtggatcagggaatattccagtctggaaaagcaggagaagtttttcgatgaattcggtattttaccttcttacacaagtttctgggaaaaggatgaagtgaggaactccaatatgggcccactgggagaggggctaaagacgagccttcccaagtggcggatccctgtatcggcagaactggattctattatggcaaatgcagtcagctcttatatgtccaagcagatgacactggatcaggcaatggaatttttcgattccgaactgaaccgtgcaattaagaataatccaccgcctgccgacagcaaaaatgacaatgcgatcgcgatagaagaagctttgaaataagggcatggggggagcgcagcggttgccggtgcctcccctttttgctttacgatcggaggaacctatgagaaaagaagagaacaaaaagaggatatcggaggaccagctgacgacatggctgtttttaatgccggcgctaatcattgtgctggttgcagtgattatccctctctgtaattcgtttgtgctgagctttgaaaaagtaagaattaatgttccgggattcataccgcagtttgtagggctggagaactacctgcgtatgcttgatgatccggtttttatccgcagtgtccagaatacagccctttttgcctttgcgtcagttcctgtggagctggtacttggcatgatgctggcgatgatgctgtccggggatgggacgggcgcacgtatcatgcggtcaattatgctgattccgatgattatggccccggttgcggccggaactatgtggagaatgatgctggacaaaaatacaggtattattaattatctgctgacgtgtattggcatgcccgcagttgactggctcggtaatccgaagctggctatattttccgttatcatggtggatgtctggagaatgactccgtggtttgccctgcttctgatttcggggatcaaatcaattcccggcgataccatagaagctgctctcgtggacggggccacgaagtggaaatgtttccgttatgtaatcctgccacagctttaccgggttctgacactggtgctgatgctgcgcgtcatagatgctttcaaggttttcgatattgtctttgttatgacggggggaggcccgggaatggcgactgagatgcttccgagctatatctacgcccagggactgcgttatttcgatgcaggatatgcggcggcactggcccttgtcttcatcgcagccatggcagttctttcatcggtatttgtattcttaagatccagggttcgggatgagtaaaggaggaaatcatgagacggaaagaaaatgacagaatcagcagtacgatcacagactttctcggaaagccaacgaaatggatttttattaccctgtttgcagtatctgtgattctgcctctgtattggcttgctacaaatgccataaaagtggaggcggattatctcgcaagccctccggttatcgtaccgacgcggataacgacagaaaattttataaagatctttgtaaatgacggcgtgggaaagggattgtacaattcggctgttatcacagctgtgtcgacatttttggctgcatccttcggaagtctggctgcctatgcgctgacaaaaggaaaactgggaaaaaggacgcggagtatctttgccggctggtttcttttacagaagatgtatccggcggtggccacggcgataccgatctatctggttatgcgcagcctgcatctgattgatacaaagacggccatgattatattaaataccagctttaattttcccatggtaatctggctgatgatgggattctttcaggaggtgccggaaagtatcgaagaatccgggaaaattgatggatgcagcatggcgcagcgatttttctatcttgtgcttccgatcgtgaaaccggggcttgtggcttccgcaatccttacatttgtcagtacctggaatgaatttttattcgctgtaatcctgagtgtcagaaatgcgaagacgctgccggttattatatccggttttattacggaccgtggactggaatgggggccaatggctgctaccggtgttgtaattatcataccggtctttgtcattgtatggcttctgcagaaggattttgtgcaggggatgacgatgggagcagtaaagggataagagcagaatggccttagccgggaaggaggaacaggattgaagaaaacaggggttttagcggaagaggcaacagtctggtatgggatcgtaagaaattgccttcttaacgacattttgggtttttggaaggagaggactgcggatcaggaacatggagggtatataacttccttcgaccgtgagggtaactgtaccggaaaagagaaaaatatctggcttcaggccagacaggtctggatgtttgcaacaatatacagtaatgtggaaaaagatccggcctggctcaatctggcaaagacaggaagagattatctgatctcccatgcatacgcaggaaacgggagatggtattatctgcttgatgagaatgggaccgttcagcagggagccatatccctgtttacagatatgttcgttttaatggcactcagcgcatacgccgcggcctcagaaacgatggaggatgagaatgtaatcagggagacatttgataggctggatcaaaatatacgaaatgaggactgccgtgacacatttcctcagggatacaaggcgggagcagtcagtcatgggagatatatgatctgtctgaattctgtggcttgtgcacggggatatttagatggagataaggcggatgagttgattcgtttctgtatggacagaattttcggcgtgctggggcatggtgatgatgggatcattcatgagatgagaacgcttcagggcgaatatatcgacagcgaggaaggacatcggattaatccgggacatatttttgaatccatgtggtttgttctggagcaggctgaacgagttggacggccggaatatgcggagcgtgcgcttcatacgatttcagttacgtaccagagaagccatgacgaaaaattcggcgggattcttcatatgctaagtgataatggaaccgacgaacagtataaagactggaatgcggctcgtcatttaaaatgggatgaaaaggtctggtggacacaggcggaggcgctgtgtgcattgctgacgtccgctgacagaaccggtgacagcgcagcatgggaagaatttaaaaccctctttctctggtgcagggagcacttctttgatccggattatggggagtggtatgcggtattaaaccgggatggatcgccgcgaatgaagctcaagggcggaattcaaaaggcagcatttcatataccaagagcgttgtaccagtgcagctgtatactgaaaaaatatgtagcggaaacgggagattgcgatgcgcagacctaatatagtatttattttagccgatgatatggggttctggacactgggaagtgcgggcaacagggacgcagttacgccgaacctggataatatggcgcgaaatggctgtactgcggaaaacttcttctgttcctcgccggtgtgttcaccggccagagcaacccttctgacaggaaggatgccgtctatgcatggtattctggactggatcttacaggggaacatggaaaatgagggagagaagcctattgaatatctggaagagtttaaagggtatacagattatctgagtgaagccggatatgtctgcggggtaagcggaaaatggcatctgggagacagtgaaaaaaggcagaaggggttctcgcactggtatgtacatcagtcaggaggcggtaactattatgatgcccccatgatacgggaagggaaaagggtccgtgaaccggggtatgttaccgaactgattacccaggatgcagtccggttcctgcgggagcgggaggggaaagacgaaccgttttatttgagcgttaattttactgccccccacacgccctggattcataatcatccgcagaagtatctggatttgtaccgtgactgcgcatttaccagttgtccggtggaaaaacgccatccatggcagatcgatttttccgagttcaatcatgacaggaaggaaatgctgaaggggtattttgcggcaacctccgctctggactttggggtaggtgaaatcagagaagaactgaggcggctgaatctggaccgcgatactctgattctgttttccagcgataacggatttaactgcggtcatcatggaatatggggaaagggaaatgggacctccccgtttaacatgtacgatacttcggtaaaggtgccgtttatagcatgtatgccgggaaagatccggccgggaatacgtttaaagggactatacagcgcttacgatttctttccaacgatcatggagattgcgggactggcgtataaagaaaaggacattccgggaaaaagctttgcaaaagccatttttacgggagaagaacgagagatcaatgactgtgtggttgtctacagtgaatatggcgcagtccggatggttcgccaaagggagtggaaatatatccgcaggtatccggaaggcccggatgagctctataatcttaaaactgatccgggggaaatgctcaacatgattgacaaggcggctcctgaattgatagaattattaaataaacgtctggtaagctggttttcggaatatgcaagaccggagacagacggacggcaggcgaacgtgacaggagccggacagaacaagaagcatactgcaagcggatttgaacctggttcttttcagatgggatacgaaacgctgccggtccgacaggcatagagcgcgggagcatttgtgcggcgccggaaagagggactatgactgaacttagtgcaaaggaagagaaaattttatggtacatctatgcgatgaagcatgtatcaagaaagagtctgttggagttgagtcattataaggcgcctaccctctaccgggtgatagaggccctggtgcagaatggatacgcagaggtatccggcagtgaggaatacgggagcaaaggaaggcccggtgagcttttgtccatgaacagcaggcatgcttatgtgttttcaatctgtatattacgggaaacattttactgtgcggtagtggatttcagcaatgatattcttaccatggaggagcacagactgattccgggcatgacgccggagcagctggcagatatcgccagacaggatttttcagaagcctgtgaacggctgggactggcggaggacttgtttttagagattggtctctccgctgtcggtcccctcgactatgcgaacgggcagatgctgaggccgttatattttttagccggagaatggaaaaatattccaattgtgcaggtgcttcagaccagatttaaccggaaggtctacttggactgcaacgcgagggcggcacttatgggaaattatcttcccaattactttgaaagacatcagaatatggtttatgtgacagtcggaaatggaatcggctcaggattggttatcaaccggaaactaatgctgaaccacaatatcatactggatggattcgctcacatgacgattgacatggatggccgcaaatgcacctgcggagaatatggctgcgtggaagcttacgtatcggttccggcaatcctggctcagtgtgtggaagagatgagactgggcatcgacagcagcatgaaaagtcatatggatcatctgacactccaggatttacagagggcagtgaggacaaaagacgctctggctgttatccagatcaataaggcggcgaatatttttgcaaaatgtattttgaattatcttcggatggttgaactggaggccgttgtgttgggcggaagcttaattgaggcagttccggagttttatgacagggtagagcagtatgccagagagcggaattcgtctgttatgttctaccgttccacagaaaaagagaagaatattttaagaggaatcgcgtctgaaattgtaatgagatatattttcggagaataaatatgctgctttacacgaaaggggaacacacatgagaaaagtatttcaatcatcggaatatcatatcgacaataccggagaacatctggttacaaaagcacttcagacgctgattgatgaaacgtcgcaggcgggaggtattctggttctggaaagaggcacgtatctgacggcgccgctgtttttaaagagcggaatggagttccattttgagggcggagcggttctgacggggactacggatgaatcgcagattccggtgattccgaccagggcagccggtgttgagatggactggtatccaggtattttaaattgcagcgggcagaaagatgtaattatcagcggaaacggtaccatagacggtcagggagaatactggtggcgcaaatactggggagacgacggaaagagcggcatgcgcggtgaatacgataagaaagggctccgctgggcctgcgattacgattgtatgcgtgtcagaaatgtggtcattatggagtcctccaatattacactgagagacattacctcaacgagatccggcttctggaatatccatatttgctacagtgaccacattcatgtggatggcgtaaagatcacatcgtgcggggcggaaagtcccagcactgatggaattgatattgattcctgccacgatgttctggtggaaaactgcatcaccgactgcaacgacgacagcatctgtatcaagtcgggaagagatgcggatggcatccgtgtgaaccgcccctgccatgatattacggtgcagaactgtgtgattcaggcgggcttcggtgttaccatcggcagcgaagtatccggcggcgtctaccgcattacactgaaaaatctgcgttaccacggaacggactgtggcttccgcattaaatcctctgtggcgagacacggttatatccgcgacgtgagggtggacggcctttccatgatcaatgtgaaatatccgttccatttcttcttaaactggaatccggcatacagctactgcgagcttcccctgggctatgagggagatctgccggcccactgggaaaagcttctggaagctattccagcttccgttccgaagacaaaggtcagtgatataacaattgagaatgtaacggcatggaatgaaccggagtatgacggcatcagccgggcgttccacatggaaggctttgaggatcagcccatcgagcatgtagtatttaagaatgtatcgctggcgtgccgggagtttggagtgatcaatcacacgaaggatatcgagttccagaatgttacagtgtccgtatccggggctcgtgatgagaaaaatgacagctacgataaccggtaatttgatatagccttagatcttgctgatcagtttgtgacggtttccgatgaggcgattccttacatgggcagccatgttcacaatataaagttccgcacagattctagtgacggccattaccacgaattctgcgggacgtcttctgccgcaataccggttggaggcggcaagcatattcattttgccaaggcgtatacgacttccgcagatggacatgttcatgatcttcaggtggcatctttgattgataatccaatcgaatagtatggaaagctggcataggaggaaaatcctgtgccagcttttttgatttggtaattttactggagagaactgccgagggggatcggcggtgtttctgttttatttataagtttactccaatcatacaaaatgcaaaaaagtaaagaagggtattgacaataaattgtgcaaggaatataatgatcgacatagagtacacgtgtacgcaaataaaaagtgcatatacaaaaaccccgattacaaatagcagaaataaatttaatgaaatataaccaaataaatgaatgcgtatttgggaaaattaacgaatgccggtgaagggagagaaaggagagggcaaaaaaataccctgagagtttatcggtctgccgcgaaacatacggataaacagtcaggataccttattcagtaccattctaaatgatttaagtaaaaaagtaaaggtttcttttcattaaaatttatatattacagttgttaaacaaccatatttcaggaggttctatatgaaaagaagatttgttgctgcgatgctggccggagtcatggcgtgttcactggcaggatgcaatacgaagtcaccgatggcaggaaaagaagagacgacaacggccgccgatacccaggcaggctcggatacccaggctgctttagcagagggggagacagataagcaggcggaagccgcaggcccgatcaccattcagttctggaatgcatttacaggaacggacggcgatgtgctgagggagattgtggaccgctataataaagagaataccagaggaattacgattgagatggatatcatgccggccagcagcttagaggaaaaacttccggcagccatcgcttccaagacagcgcccgcccttattatcagaggtaattttgatacggcaacttatacggataatggaattttgacgccgcttgatgatttcttcgagcagaccggagcggatgcctcgaatttcagtgatgcatctcttcaggcgcttcagtaccagaaggtacagatgatgattccgatgcaggttcattccacgttcctttactggaataaagacctgtttgaagcggcgggacttgatcctgagacaccgccggcaacatgggaagaggcggccgagtatgcgctgaagatctctgatccgtccagaaagctttatggaatcggtttcccgatcagcggcgcgccctgctattttgatgcaatgttcaagtccaacggaggtgacgtcttctctgcagacggtaagagttctgttctggacagccctgagaacttaaagacccttcagtatattcagaatctcgtcaatcagggggctgcgccggttggatctacaggagccgatacggataacttaatgcttgccggacagatgggaatctactgcggcggtccatggctgatcagcggactgaaggaagcggagatcaattttggtgttacgggaatgcccgcaggggacaaggaagctgccggtgtcatcgaggtccagggctttggagtcacctccacggccagtgaagaagaaaaggcggcggcttacgactttatcgcctactggaattcagacacgacttgtaaagagtggtccctgcgcaacggatatccgccatatttaaagtctctggcagaggatgcagacatcaaagcggatgcaacagtcaatgcgctgtcctctatctctgagtttggattttcctttgcaccgggaattaaatctgtaaaacaggtcaataacgacattttattccccatgatcgaaaatgtagtggccggcaacgacccgcaggaggaactgagcaaggcgtcggagagcatcagcaagctgctttctgagtagacagcagtacatagaggtgatttcattgaataatataaaaaccagaaagtccccttcacgttcattcggcagaaaatactggaataaaccggatcgggtagcatatttatttatgctgccctctatcctggtactgttcgtatttgcgattattccgctgatggcatgtctcgtaatcagtctgtttgacatgaatatcttctttacggacaccagttttacaggggcccacaactttatcacggcatttcaggatacacggttctggaacgcactgctgaacacggttatattcgtcctgtttgaagtgcctcttcagattgtgatcggactcttgacggccaatgcgctggtaaagaccagcctctttaacaaggcggccagatccatcttcttccttccggtagtctgctccatggcggcggtaggcattatctggtccattcttttagataccaatatcggattcataccgtacttactggaacagattggtattcataacgccacctttttccgaaattcgaagacggccatgccgaccgtgatcgccatgacggtgtggaaaaatttcggctacaccatgtccattctggtagtgggaatccaggggatctcccagagctactatgaggcgtcggagatcgatggggcagggaagacggcacagttctttaagattacactgccgcttttgaagcccacgctggggttctgccttattaccaataccatcggctctcttcaggtgtttgaccaggtgtacgtcacgacacagggcggtccgcagtttaagaccgagacgctggtacagtatatttataaaaccggttttaatcagccctacaatctgggatacgcctgcgccctttctgtgcttctgctggtggtgatactggctgtctcccttccgatgtacaagaacatgtttattaaccagaattaggaggccggggatgaacgaaaagaagagaagacgtgtgacacttttaagtgtggttaagatcgtatttacggtgttcctgattgtgattgtcctgtttccgcttatctggatggcggtcgggtcctttaaactggaaaaggagatcctgggatatccgccgactgtttttggaacgaaatatacactgaagtccttccagaggatttttaagacaatccctatggcatcatatattaaaaataccgtgatatttgcaggcggttcaacgattctggcagtgctgtttgactcattaacgggctatgcgttcgcgcggctggattttaaggggaaagatctcctgttcatgctggtgctgcttaccatgatggtaccgttccaggttatgatgattccgctgtttctggaatcgaatctgctggggcttttggacacctacggcggactgattctgccgaaggccacctcggcattcggcatctttatgatgcggtcctacttcgcggctcttccgaaggatctggaggaagcggcaagagtggacggcatgagcgaattcggtatatttgcaaagattatgttcccgctggtaataccgggggtactgactctggctattttccatctgatgcagaactggaatgatttgctgtatccgttaatgatgaccagcagcacgaggatgaggacgctctccgcaggacttgcccttttcgtgggagaacacgcgaccacttattacgggccgcagctggccggtgcacttctgtcggtgctgccgctgctcgtcatttatatctttttccagaaatattttattgccagtgttgcgaccagcggaatgaaggactagcactgcgttgcataagttccgatgaattctgcactcgctattcacgccagggccacgcccgcgaagctagacgtagggtccactacgccgtcgcttcacggatgcgcccctgacgcaaatatcaagcacagaattcaccgaaacttacgcaatgcagtactggcactgccaggctgctgaaacagaggagagaaaaaaacaatgcagaaagccagaattacgatcaatcgagagtttaaaaagggttccgttgacgaccggatctatggaagctttgtggaacatatgggccgggtggtctattccggaatctatgagccggatcatccgctggctgatgaggatggattccgaaaggatgtgctggaggcggttagaaacgccggcattaccaccatccggtatccgggcggtaatttcgtctcctgctataactgggaagacggaatcggcccgaaggaggagcgtccgcgcaggccggagctggcctggaaggcggtcgagacgaatgagttcggaaccgatgaatttatgaaatggtgtgaaaaggccggggtgtcaccgatgctggcggtcaatctgggaaccggcagtatccgggaagcgttgcattacctggaatactgtaattttaaggagggcaccacatacagcgaaaagcggaaaaggaacgggcgggaagaaccgtaccgggtccgcacctggtgtctcggcaatgagatggacggggaatggcagctgggccacaagggcgcttctgaatatggaaggctggtgagagagaccgccaaggccatgaagatcctggatcccggtgtggaactggtttcctgcggaagctccttaaataccatggccacattcccggaatgggaggcgcagtctctggatgagacgtatgagtatgtggattacatatccctgcatcagtattttgacggccatgaaaagcctgtggaaagcttcctggcacaggcggatgagatgagtgactacatccggacagtcacatcagtctgtgactatatcaaagcgaaaaaacgctcttccagacagctttctattagttttgatgaatggggcgtgtggaccagggcgtcaaaggagacggtaagagagtgcgacgagagcccctggcagaaggcgatgccgatcagtgagatggtttacagctttcaggacgcgctgctcttcggaggaatgcttctggcaatcctgaaacatgcggaccgcgtcaagatcgcgtgccagtcccttttgaccaatgtcagcgcgatgatcatgacggaaaagggcggtggggtgtggctgcagccaatctattatccatttgcggatactgccgcctacggtcacggccacgtcatggactgccgtgtaacctcagactcggttttatatgagaagaaagagatcccgcttctggatatggccgcggtggagaacggagaggagatggttgtatttatgatcaaccgttctccttcggaggagatggaggtatcactggatttacagggatatgaggcggaagctgtgctggagcaccgcgttcttacatcggacgatccggaagccgtgaattcaccgggccatcagccggtgagaccggaacaaaaggatgacgctgccataaaagacggaaaagttgcggttatgcttgacaggctgtcatggaatgtgttacgaataaaagttaagtgacagctgccggaacaggaacagagaattccggcgcaaataatgaagaaaccggaggcatggtgcaaaatgggtgttacgacgaatgatatagcgagaatctgtcaggtttcgagaacgaccgtgatccgggccctgaacaatcagggaaggatcagcaaagagacgaaagacaggatcgtgaagacagcggaagaactgggatatcggccggatcttctggcaagaggactggtaaagggaaagacgatgtatatcggcgtcgtggtatttgatgttaagaaccagtattttgcccagatgttaagtgcaatcgagacggaggcccagacaagaggctactgtgtaaacatcacgctccatggaaagaacagggaaaaagaggtggatctaatccgaaagctggtggattaccacgtggatggcctgattctttccccggtaaataaaggagaacattttaataagtttctgaagagtctggacacaccgctcatcgtcattggaaacaaggtttcggatgagattccgtttgtgggaatcgatgagcggagggcggcaagggaagcgacggataagattctggattccggctatgagcgggtggtgtttgtctgcccgcctctgggcgagtccaaggaagggaacaactatacccatgagcagcgtctggagggctttcgggatgcgatggggagccggttcacgggggcgcagatcataagctcggaatcgtacgaggaggaagcggcttccattctggaagagggcggcggcaggactgcatttttctgttccggtgatatctatgcgatggatattatgaagtatttgaaggcacgcggcaaacgggcgccgaaggactatggaatcatgggttttgatgatattgagcttctggaatacttatctccgcgcctgtccaccatctataattcggtggaggaagtggcgaaaagggcagtggagcttctgttcgacgagatggaaggccgggaaattgccatggaaacctatgagcgctaccgccttgtccagggagagactctgtaaacggagaggacagacatggacagagatcattatgcattaacggaatacaacgttccgctgattgaaaacagggctgatccgtacatctttaagcatgaggatggtacgtattactttaccgcgtcggtccctgaatatgacaggattatactgagaaaagccgcggccatatccggtttaaaatacgcggaggaaaagacactttgggtcaggcacgacagcggaccgatgagctgtcatatatgggcgcctgagattcattatatatccggcgcctggtacatttattttgctgccggagagaaggatgatatctggaaaatccgcccttatgtgctggtaaacaggggagacccgatggaagatgagtgggaggaactgggacagatgaaggcggcggaatccccggagcctgacaaattctcatttcaggatttttcccttgatatgacggtgttcccataccgggaaaaatggtactgcgtctgggcggagaaggtgaatatcggcaaaaagatatccaatttatacatcgctgagatggaggcgccggaccggcttttgacggcgcaggtgctcttaagcgcccccgattacgactgggagcgccgcggattctgggtgaatgaaggagcggctgtcttagagagagacggcaggctgtttctgacgtattcggccagctcgacgggagccgattactgcatgggaatgctgcgcttacggagaggaggagatcccctcgatccggctgactggtcaaaatccagagaaccggtgatgaagaccgatgtggaaaaggggatattcggccccgggcacaattccttcgtgaaatctgaggacggtctcacggatattatggtattccatgccaggcagtatgacgagattttgggcgatcctctgtatgatgagaatcggcatgcctatacacttcccgtggagtgggatgaaaatgaggagccggtgtttcagtttcggaagaacaggcgtcccaatattttgatgatggtagtggaccatcaggcattttacggtcattccagggtgaagacgccgtattttgaccggctgaaggcggagggagtgttctttgaacgcgcctactgctcctcgcctctcagtatgccttccagaaaaacgatgatgacggggctgtatccccaccatcacggccagacggacaattcctttgaaacgccctgggacagccatgaaacgtatgtggatgtccttaaggaagccggataccggaattattactttggaaaatggcacgcctgcgccggaaaaccgtcggatctgggatgccttggggtgtcctacccggattattccaatccataccatcagccggagtacgaagagtaccggaggcggaaagaacttccgccggccagaatgcgcgtggaaatgaatatgtgcgagaagggctggatcgacgatgtgaaggagggggatctctataatttcccgcgggatctcacgaatgaggcgctctccggcatcctggagggaccgaaagagtgccatgaggcgtactatgttgcggatatggcctgccgccagctggaggagctgaaacgggaggaggctccgttcatgatgcgggtggatttctggggaccgcaccagccgtactgcccgacagaagaatttgcggcgctctatccgccggaatccatagaagaatacccaagtttttccgatgatctggccggaaagccgagatcctacctgttcgatacgggaagggaaacgagccgtgacaaagagctgatccggccgaatcccatggaatggtcccggtggcagatgctcctttccagatgctacggccagatcactatggttgacgaggctgtgggaagcgtgattgagaagctgcgggagcttcagatggatgagaatacgctgattatctggaccgcggatcacggtgatgccctggcctgccacggcggccattttgacaaggccttttatttgccggaggaggtgctgcggattccgcttgcgatggcctgccccggcgtgctcccgaagaaccggatctgcagggagctggtcaccaactgtgatttggctcctactatcgtgagcgctgcgggaggcgccttccgctcacccgtggatggagaggatatactccggctgttcacggagcagaggccgggctggaggacggcgctcctggcagagacctacggacaccttgcgccgtggagggcggaagcagtcgtatggcagcagtataaatatgtggataatcatggggacgcggaggagctttacgatctggaggccgacccgtatgagcttcataacctggctaaggagaaagaatatcaggcattgcttatgaagatgcgcatgaagcggatggaactgaagccgcacatctataagatatagtcgcactctgtaaaatgatcgagcgaggattgaaacaaagttgaaatgccggaaatggccgagaggctgactttccggcatttttctttgccgggggagagaagtgagggatcttaaggtactgcgtccctggattttccggttcattctaaaatttacgaagtctgtttacacaccggataatccagtgtataattaaaaaatgctcttacgaatgtaataacagggcgtgtatacataattgaggggaacaaagcatgaaacgttttttgaagaaattactctgctggacactgatcagcaactgttttctcatgactgcctacgctgctccggcatggccggccggaccagatatacaggcggaggcaggagtcgtcatcgacatggattccggcgccattttaggtggaaaagcgtatgatacgccgtacccgccagccagtattacaaagcttcttacggctcttctggtaatggagcacagcaaactcgacgatgtggtgacattttcaagcagcgcgatcaataacgtggagtccgacagcggtaataagctgaatgtggcagaaggagacaagctgtccgtggaggactgcctctattccttgctggttcattcctgtaatcaggcggctaacgcgctggcagagcatgtggccgggtctcaggaagcgttcgtgaagatgatgaatgacaaggccgcggcgctgggatgcaaggacagccatttcgataatccctccggcctcaacggagacacacagtacgtgacggccagagacatggcggcgatctccagagcggcatttgcagagccggatattatcagaatcagcgcggcgctgacacatacgtttccgcctacgatcaacaatccggatggcctgacgatttatgcggagaataagctgatcctgaatacgaatgactcttcaagccagtactattatccgccggtgaagggcggcaagacgggatacctcttaaaagccggcaacacgctggttacctatgcggagaaggacggaaagcgtatgatttccgtgattctgaaggggagtcccggacagtattatctggacagcaaggcgcttctggaatatggatttgcgcattttaccaattttaatgtagcggaaaacgaaactgcctataccgaaggcgagacagccgtggaggtggccggaaaaagctatctgccggcggatcttaagattgatccgtccggaacggtgacacttccggagggcgcggtatttgcggatacggagcacacgctgacaaccgattttccggacgagcatccggagagaagcgtggcgtttatccagtatacatacgacggacggaaggtgggcggcgcctatttgacgcagaaagaagtgcaggaaccggtcacggagccggcaacacaggaagagacaaagccggaagcggatgacaagaaagagggcgtgaagaaaaagttttccatcaatccctttctgattatcgcactggtggtgattgccgccgctgccggcggtggagcgtatctgtcatactccagaaagaaagaggaacagcagcgcgcgctccgcagggagcagaggcgcagacggcttcgggaagaaggcgtgacggaagaggaattcgaccgtttgctgaaagagcgtctgggagaccgtagtaaagggaataatcgaaagaagagatagaaaaaaggctgtaccgttcacccgggaaccgggagacggtacagccttttttatgcttaattccggcggctgccgcgggagtttgttcagtgactaacgattcctggccgcctgtgtgatatagttgccggtaaatgcgaggcccgccagaaccagcgcggttcccagccctgagtaaaagactgcgataaagatatccgggcagaggccggaggtgcgcaggccgatcccaaaggtcatcataaaagccatgatgcagaaggacttgcggtcaaagaacttcagaatgaactgcatctcttcctcatagcgtacaatccggtcggtgtgcctgcgtaccagtttgccaaacaccatgaaccagaaaaggaaaaatactgctgcggaaagggccagattgatcagtgtcacatagcttttataggaaatgatcccgatacgcagaatattaaagccggctgcgagccagacaatgcctgcaagcagcagtagataattttttttgattttcatgtgaatacctccttaaatgaacaacgttcattatatgccggttttggagatatgtcaagtgatggcgacgcagtttttttgaattttttgtgtgggcgggagcgcgggcttattgacagatctccaaatgattgaaaaccccgcttaacggacagaatacaggaaaagatatgttacatttttcttaacaatagaaatgatgtattgactttaaatcttacatatgtaataatttataaaaactcgttgcaggacgcgaagtctgcgggagcggatgtgagatttgacggaattgtgcgtgaaatgtcatcatcaggaaaaggtatgagaacgaagctgtaaagagaggaaccatattatgagacgtagaaaaagcaaacgtggactgatgatcggtggtatagctgcagggatcctgattgctgcggtgattgtgacagggattttctggtttcggagagggggagaggcggagaaggagaagaccccggaagagctcctaatggagtacacggattatatcaggaccggtaactacgaggcgatgtatggaatgctgaacgaacagagccggaagaatatcggtctggaggactttacagcgagaaataaaaacatctatgagggaatcggcgccgccgatattcgcgtggagatccagagtgtggaggaacgtacggaaggtttgaagacggtcagctaccagacttcgctcaacagctccgccggcgagatcaatttcctgaatcaggttgattttatctgggagcaggcggctgagaaccagggagcgaagaagaaaaaggcggcgggcggctatcggatgatctggaatgatcaggttattttcccgaatctgggccgcaccgataaagtgcgtgtctccaccgaccggtctgtgagaggggaggttctggaccgggacggcggcctgcttgccggaaaagggaacgcttctctggtgggccttgtgcccgggaaaatggccggttataccgcgggaacggagggagagacttccggcacgagccctgatctggagcggctttctgagcttcttggtgtctccgtggagagtatagagaagaagctggcggcaaaatgggtgaaggaagactccctggttccggttaagacgctgaaaaaggtagatgagtttgatctccagtcagcgagtccaagagaggataatgtggagaataaggcgctccaggacgcgcttctggccataccgggcgtgatgattaccgatacaccggtgagagcctatccgctgggagaggcggcgtcccatctggtgggatatgtccagaatgtgacggctgaggatttggagaagcatccgggcgagggatacttatcggacagcgtcatagggagaagcggaatcgaaactctgtatgaaaaagaactgaagggacagaacggggagaagatttccatcgtcacctccgagggcgcggaaaagctggttctggccgccataccgcgggtagacggcagcaatatcacgctgaccatagacagcagcctgcagaggaccatctacgagacgttcaaagacgtcaagagctgcacggtcgccatgaatccttacacgggtgaggtgctggcactggtgaatacgccgtcgtatgacgacaatgatttcatactcggcatgtcagaggagaaatgggcctcgttaaatgaagacgagagaaaaccgatgtttaaccgtttccgccagcgttttgcgcccggctcctcgtttaagccgataacgggagtcatcgggctttccacgggagcgctgactccgggcgaaagctttggcacagaccgcgcgggacttagctggcagaaggatgccagctggggaaagtatcaggtgacgacgcttcacgactacagcccggtcaacctggaaaatgcctatatttactccgataatatttactttgcgaaggccgcgctgaagatcgggtatgacgactttatggccgggctcgaccgcctgggcttcaatcaggatctgcccttcgagatctccgtatcccagtcccagtattccaacacggaacggatcgagacggaaatacagctggcggacagcggatacggtcagggacaggtgctgatgaatccgattcacctggcggccctttataccatgttccccaaccggggagatgtcataaagccatacattgcgtacaggaaggagccggcatcggaagtatggctgaagggtgcctgtactcctgagattgcggaaacaatcgataccgctctgaaaaaggtaatcagctcggagcacggaacaggccgcgccgcgatgcgggcggatattacgctggcaggcaagacgggaacggccgagataaaagcgtcgaaaggagacacctccggaacggagctgggctggtttgcagtctatacggccgacggcccggaccgcacgccgatactcatggtcagtatggtggaggatgtcaagaatgccggaggaagcgggctggtggtgagaaaggcgaaggccgtgctggattcttatattccgccggtgcagtagtgaacttaccggatttatggtagaaattgccttgtaatgatgtacctctgaatttgacagatacacacggatatagtagaattgtgaaggcatagcgcgtatttgtctgtagtggatatgtgcattttacaaattcgatttgaggagagaatcatggattacaggacaaaagcaataaactgtgtaaaggataccgtattacctgttcagatgcagtggtttcaggactgcggcttcaatatggatacatattgtcagaaatatggagatacagagcattcctttgcaaaagaaatcgaaaagggccatatttatgaaatgggttatcccaaatgcgtatgtgaggaagcactggcgggaggaaaagacgcttccttctgtgaatgctccagacagagtatgatatacgttttggaaaatatgatgccggaaaagcacatagaggtggagataatcgaaacggttttgagcggagctgaaaagtgtcggtttaaggttacggtcgaataagcggttttaagccgtttttccaatttcaggcaataaaaatgtcatctgacgggaacgcagtggtttcgtctgatgacatttttattacccataaagctgcttctctttcaggatacgcagtgcgatctctcccgcctttgtaccggttgccccgtcgtctccgttaatatggaccgcaaaggaacaggagccgttttcagattctatgaagccgataaaccagccgttggtgttttttccatcgactgtgccggtgccggtttttccgtacagtgacgatgtgccgtctgaggagaggaaaagcgcgtccttaacggtctccatgtcacgctccgagtacggcagcgtgtggctggataattcagccagcagcttcacctgttccagaggagatattttcaaggaggattccagccagaatcgggagaggcctcctgaaaagtccagatttccataggagagggcggtaagctcccgcttgatcgagtccaggccgctctggcggtccagattcataaaataccagttgacggagttcgtcatggcggtattcaggttctggtccctgttccaggaatcgaagggacaggcttctccgttccaggccatggcagaatccttcgcagtgatgatacccgcgtcgagggccatcagggcgctgtagatcttgtaggtggagtttggcgaaatccttgtgcgggcgtcgtcctcattggatatcagataacggttttcggaactgtcatacaggacgaagctgccgtcaaagtcttcgaaatagctgctcaaatcttctaaagacgcctggggcagagccgcacgatagtggtctgaggaaaatgcgagagcggaggcggacggcgtggtacagatcaccagcgctgcggtcaaaagatacagcagccggctctttaaccgtctgttgccggtttcccggcggtaggaggcaatgtacagaatccgcttccggatctctttgcggctgccgccgatgccggctgtctgcccgaaggtcagatgggagagactggctgcaaaatgaagcagggcatttccataatcacaggacgctttttcaccaagaagggccaataccgctgtatcgcaggcaatttcccggtcgctgtccatctcctttaaggccagccagaccagaggatggaaccagtaaaaaatcaggaggaggcggaaaagaacgccgctcatgatatccttatgcttgtaatgcaaaagctcgtgcagcagaatgcagcggatctcgtcttccgatagtccggagagccgggacgccggtagcagcacacaaggcgcggcgattcccgccgtaaccggggagcggagccgggaggaagaacgaagcggaatgtccctccggattccaagctgcctcttacagtcctcaaatatgtcccgcaggactgcatcccgaacgggaagggcagtcttctttaaaaaattgacccggaccgcggaaataagggtgaggactgcaagtaagaccgctcctccaatccagagggagagaagggcaaatgccagataaccaggcatttcccggctaaccgaaacggaaaaatcatggagcagtcccgtggctgtaaaaatattaccggcagcctccgggcccccgccctgccacgaatccccggccggggccgtccgcagatcggcaaggcgggaagtcagcctgcccagccatggaaatgcttcagccaggaacggcgcggccgcaaggatcaggagaagaaaccacaggcggtaacgggtttccgctgtcaagtaccggtcaaacgcttttcgtatgaacataataatgccgccggaaactgcaatggcggcactgctttgcagcagataaagaagcagagattctgccatctgctattctccttccccgccatgcgataggaggccgcgaagctcttccagttcctcctgggagatccgttcgtccttcatataatttgccaccagtgaggtcagatttccattgtagaaccgattaagaaaatgctcactctcctggcttaaatagtcttcctttgctaccagcggggtatatacaaagaccctgcttttcttttcatatgtaatggcccccttctgcacgaggcgcttaagaagcgtctggatcgtcttggggctccactccgtagcctctgaaaggcagtccgtcacttcgttggtgcttatgggagctttgctccagatgactttcataacttcatattcggcttctgatatctgcggcagcctgctcatgataacctccctgttcttacaaatgtaatagacatattatacgcgagcggaacaccgctgtaaagggggcgggatcaaatatttgagcgagttttcttatcgttttctcatttgacggatccggcaggaccatgatatactagtgctggtactacggacagttagaagcaaaactggccccggccggagactgtccggccaatcatacaagaggtgcgaggtaagacaacatggtccaaaacaggggaattaaccaggacgtgacacaggagatgaaccgttctctccttttaaaaaatttaagaagagaaggcatgtgttccagggcatatctggcttccctgacagggctgaagcaggcgaccgtgaccaatattatgaaggatttcttaaactggggaatcgtcacggaggtgggctttctgaatggaagcaagggccgccgttccatcggcgtatccattaatccggaccgttaccgggtcatcggcgtgcgtcttgcgagaaagcattacagcgtcggcctgtttgatttgacagggacgcagataacgaagaagcgagtggattttaaaccggaagagcagccggatgcggaagatattctgaatcagatcgcggccgagatgcgcattctgatgaaaaaatacggaaaagatactatactggcggcaggcatggctgtgccagggccgtttatagcgaagaaaaaccgaatcgctctgatcacgggagccgatatctggaaggatgtcgatttaaagaaattctttgacagagaactggacatccccgtgtttttagagcacaacgccaacgccggcgcctatgcccatatgtgggacttaaaggacgcctaccgcgatgatattctggtctatatcgcggccggtcagggaattggcgcgggaattgtgatggacggaaagatttataagggtgctctgggaacctcgggggagatcggtcacatgaccatcgaccggaacggaaagccttgcgcctgcggcaataagggctgtctggagcggtatgcctcttccctggaattagtgaaggcggtatacggcgaccaggcgggccgggcaggatgtaattttgaagatgtggaacggcggatccgcgaaggcgaccagttctgtatggactgctaccagcgcgcctgcgagagccttggaattggaattatcaatattgtcaatgtcatcaatccggatatcatcatcatcggggatgatatggcgagaccggatccggaacgaatggaggctgtgatccgtgaaaccgtgcgggaaggcattctggccgacgtgtgggaggggctgacgctgtcgatcagcacctatcagggcgatccgatcctgacgggagcggcaatcgtcgccatcgaccggattttcgacagtccgggccagtttatcccagcaacgaatcaggtgggtgcctgcgagcccgtctgacgaatggcgcaaagtctacggagcgtagattgtccccgcaggctttatggggtacaatggaatacgaggtgataaacatgaatacagaacgcaaaaaacagcttattatggaatacaaaaaccgccatccggagatgggcgtgatctctttgaaatgcagggctaccggcgaagcatttctgggaatatcgggagatacgagaaccgcattcaacagcgtctgtgccagattatcgggctcttcccatccgaaccggcatctgcaggagctgtggaaggagtatggggaggaaggctttgagcagtcggtgattaaggtgctgaagtatgaagacccatgcgaggaccatacggaggaactggagctgctccgggaggaatgcctggaggcggatgagaaggctgtcaagatctggaaataaaagaactggtaaaaaataactggtaaaagagccggttgttgtttagaagagaccctaaactgcggggtctcttttgttttgcccggaatcttaggcacgggagtttgaggttgagaattttttgagaaacgtttatgatggtgtagtaggggggaaacagaaaaaattggaggaggtatgatatcaaatgtatcgtttattaatcgtagatgatgaacgggcaaccctgaatggactgtgcaattatattccatgggatcaaatggggttcatcgtggagggaagcgcggctaatggaaaggctgctcttgcatatctggagaatcatacggtggacgtgcttttatccgatatccgtatgccggtgatggatggcatagagctggtcgcaagggtccgggagctggggtatgacatggaatgtgtatttttaagcgcacacagagattttgagtatgcgaagaaggggctgcagtacggggtcctggattatattttaaaaccaaccaaatttggtgatatcagggaagtgttcgggcatgtcagggaaaagctggatgaaaagcggaatcgtgaagagatccgggaagagaatatgggaaaggacgtgatctccctggtaaagaagtatgtggagtcccatgtccgcaccgccagcttagaggatgccgcggattacgtcaatatgaatgcccaatatttaagcaggctgtataagaaaaaaagcggacagaacttctccgattacgtcatggaggtgaagatgaaggaatcccagcggcttctcaaggactcccgttatcggatcagagaggtcagcgagatggtcggatataccaatgaaaaaaactttgcccgcgcgttccatctgttctgtcaaatgagtcccagagagtaccgcgacagtcagagcggcagtcagacgaatggaggaaaaaatcatgaggcagagattttataagcataaatacttttacaatatgctgatcaaattccttctcccggttctcctttccatcacggtggtcggcggagtgggaacggctgtgggatactcctatttaaaaaccgagctggatcagacgaaccagaagcttctgcagtctaccctgtacagtacggagctgatgttaagcgaactggaatccctgatgctggcctttgatattaacccggggattatcaataaatgctatcacgtattgaatacagagtccctcggctaccaggagcatcaggatttaactaccatagaaacgtttatcaatgccccggtcaacgccaggcagtacatagacagtatttatatctattatcccaacccctataaccggtttatccggtctaacaacagagggggaatgctgggaatcgggatagatgagggatggcttgaaagctatcaggtgcataaggataaagataagacctggagtgaacgccgcaggttgggaaccacaggccgggatttaattaccgtataccagatgatggactacgatggtgtgatcattctcaatctggatgcacggtatatgaaagaactgctggattccgcaaaggtattttccaaccagtcagtctttatctgcagccagaacggagatgtcctccttcagacaggccctgtcagtctggaggaagcacatggaaaggattctgttgtctatagcatggattcagaacggtatcagtggtcttaccagtcggccattcccaagattgaattttacaggcttccgcttctgattgtcagatacacctttgtatgtattttgctggttacgtttttaggcattcttctggcttatgcggccacccgcctcagctattgtaattttgagacgcttcaggaactgatggaggcggccagagaaggcaaggatattcacgaatatgaagtaaaagagtcctctgactatttcgcatacatcaccagacagatgatacagaatttcatcgagcaggatttcttaagggtccagttatcggagcggaaatacaagctccgcgctacggagctgctggcgatgcagtcacagatgaatcctcattttctgtataatacgctggaaaccgtcaactggaagatcatggaacagacgggaaagcgcacggcggccaatgatatgctggaagatctgtccgagattctggtttattcgctggatgaaagagagcaggccaccctggagcaggagattcacgtaacggaatgctatatcaagatcttaaaggagcggtatggcgaattatttctggtggaatggagctatgaagaggaggtgcttgcaattcccgtcgtaaagtttgtccttcagccgcttttagagaatgcggtgaatcatgggatcagggaaaaagagggcggaacaggcagaatacggataaagatatttgtaaagggggaaaaactgcatattcatgtggtggacaatggagccggtatagagaaagaaaagcttacccgtctgcgaaaagggctggaagagggccggctgggtgacagccatatcggaatattcaatacgaataaaaggctgcagcttgcatatggagaaagctgccagatgaagattaccagcagaaagggcgaaggaactgtggttatgctggtgataccaatgtcaagaaatgaggtagaaacagcaaagaatgatacgttctctttaaattagtcaatcgatgatgtagttatctcgacttggacaggttgtataaaaaaagagatttatttatacttttcttatgaacatttccaagatgaaacgctaatgaaaaggaggaaaaggaatgaaacgatgggggaaacgggttacagcgttatgtctgacagccggaatggtgatgcttaccggatgcagcgcggcacagccggaaaaggccgcagatacgacgacggcggcggcaacgggggatacggcagcgccagccacagagaaaggggcggctgaaaacacggacgcagcagggcaggaggtgtctttccggtatgaatggtggggaggcagcgctacccatgaggcctatacgaatcttcaggcagcttataaggtgctccatccggaggtcacgatcgagccggagtattccgcctttgacggataccaggagaaggtagttacccagttagccggcggcacggtggcggatttattccatatcgatgcgccctggatgatggagtgggtcggcagaggagattactttacagacctttaccagcaggatattctggattacagcagcatcggtaaagaactcctggaccagtactgtgtttttgacgggaagctgctggctgttcccatgggggttcagtgttccggtatgctgctgaatacggtggctgctgaaaaatacggattaaagatagatcatcagctgacatgggaagagatcattgaactgggaaaagagcttcatgagaaggatcctgacgcctatttcttttccgcagaccatggacatgtgctgaatgctttgctggcgatgataaagcagcggaccggcggtcaggtgatcaatgatgactttacgattgcatttaccaaagaagatttactgtatgtgtataatcttatcaaacaggcctatgaatcgggtgttttcgagcctatgggggaggcggatctctattacggttcttccacacctaatcccaagtggatcaatggggaggagattgcctgtctggtgtggaacagtgagtttaccaaggtcgatgatttgctggagggtaaggatgaggcgactatgatcctctggccaaccataggcgaaggggcaaagcaggggtcttcccagattcgccccacctatctggtcggattgagcaattcttctaaggtaccggatactgcgctgacgtatttaaactggcagctcaatgatccggaagcggctaagattctcgggtctgtccgtgcagtcccgaccacggaggctcagcaaaaagcagctgtggaaaatggagtgctgagacagccggttatcgatgctctggatgaagcttacggcaatgtccaggccagggacaacggtccgtcgcaaaacagtgagttaagagatacccttaccgacgaattctccaaggttgcttatgggatggcgactccggaagaagcggtagagtcgacttttactgctctggaagaggttctgcagagaattaaaaagtaaagaagaagctgccgcacggaagaacgcaaaccgtgcggcagcggctttaccggcgaaaggagaattgcaatgggcaaaaaaataaaaagcttaagccgtattgaggggcttatttacatatcgccatggctcataggctttctggcgcttcagctctatccgtttctggcatcactatattattccttcacggattatgccatggtggggaatcccaattgggtcggattggagaactttataactatttttaataaggacagagaaatctggcattctctaaagattacactcatttacgttgccatagcggttccgctaaagctggcgtttgctctgtttatcgccatgctgctgaatctgcgggtaaagggaatcggcatcttccgtacggtatattatctgccgtcgatcctgggaggcagtgtggcaatcgctgtactgtggcgcttcctgttctcgggaaacggtaccatcaataccatgctttcctggttcggcatcaaaccggtgggctggctcagtaaccccaggatcgcactgtttacgctgagcctgctggcagtctggcagttcgggtcttctatggtggtattcttatccgcccttaaaaatgtgccagccgagctttatgaatcggccagagtggacggagcaggcagcgtcaggtgcttctggtctgtcacgatccccctgattacccctacgatcctttttaatctggttatgcagctggtctccgcatttcaggagtttacgggagcatttgtcatcactaacggcggccctatgaagtccacatatctttatattttgaaggtgtatgatgaagcctttaagtattacaaaatggggtatgcctgcgccttgtcatggattctgtttgtgattatgatcacagttaccctggtgatattcaaatcatccaacttatgggtattttacaacgatggaggtggcgccagatgaaaaagaaaataaggcggggcgtgatgtatctgtttcttataaccgtgggaatcgtcctcatttatccgctggtatggatgttctttgccacatttaaaacgaatgctgaaatcttcggctcttccgctcttctgcctacccatataagtctgaatgcctatatcgagggctggaagtcgggcggaggcgtatacagcatgggacattttatgaaaaatacgttcctgctggtggtccccagcgtgctgctgaccgtcatatccagcactttggtagggtatggatttgccagatttgatttcccattcaagggatttttgttcgccatgatgctgtcgaccctgatgcttcccggtactgtgaccatgattcccaaatatcttattttcaataagatgggctggctcaatacctacctgccttttatcgtacccgctgccctgggaagctcggcatttttaatctatatggtactgcagtttatacggggaattccaacggaactggatgagtcggcaaagctggatggctgcggttctttgcgaatcctgatctatttaatcgtgccgctggcaaagccggcgctggtatcctgcgtgattttccagtcactatggagctggaatgattatttcaatccccttatatacatcaacagtacgaagaagtttccgatttccctggggctccggctgatgctggacagtgccggaaagaatgcctgggatcagatcatggccatgtcggtcgtggcgattcttccctgtctgatcctgtttgccgtcgcgcagaaaacatttgtggaaggcgtgtccacggctggactgaaggggtagcgaagaagacatgttaaggagcggagcgatggagtgtaagttcaatcaacaggaattagagaagatcagagaatgggtatacggccataaagaggaattaaaagaagatttaagacggctggtggctgtcccaagcgtctccgaaccggacagcggtgagaaaccgtatgggaaggaatgcaaaaaggtattggaggaaatgatggcgatcgctgcctcatacggccttacagcgaccaattatgaataccactttgccggcatgggactgcgcccttacgtctatggggagaatgcgatctctgtctggaaccatctggacgtagtggcggcgggagacggttggaccttcccggcctatgagatgagcgagaaagacggttttctgatcggaagaggaatccaggacaataagggaccggccgccggcgcactgtacgcgctgcggtatctgaaggaagaagaggagcgcctgggactccgtcataattttgtactctttacaggctgcagcgaagagcggggcatggaggatatggagtactttatgagccattacaagatggacggctttcagctggtggcagactgtgcctttccgctgggacatggggaaaaggggattttaaatcttacttatgaaaaacagctggagccggacagcatgatactggggctgtccgccgggagcagtgtgaattccattccgggagaagcacacatccggctcaaaaaggttcccgggcttatggaggccctgcagcatttggggaagaatgggatcaccgtggaggaagaaccggagagtctgaaggtggaggcgcttggaattgggggccatgtcggatttccggaaggaagcgtccatgcgctgtatgttctgacggaagcgctgcaggatctggaattctttcaggaagaagacagaaggctgtttcagtttctgtgcaggatgaacggtgatttccatggtaaaggtgctgggatcgcatgtgaggatgagctttccggagcactttgcggagcgctgaacatagcgcggtatcaagaggacggatcgaaaaagtacgtatggatgcagtcggatcaccgttatccgattaccgggtctgcgggggcagagattggagagcggctggtgcgtctggccagtctttacggctgtaaggctgtcataaaaaaggatgagaagccctattatctggacccggagagcgatacggtgaaaacggtgatgagcgcttaccgcgcggtaacaggaaaggacagcaggccgtttaccatgagtgggggaacctatgccagaaaactgccgaacgccgtatcgtatggcatgtcattggaaaagaagagaatttatcaggatccgaaaagaccgggcgcatcgggcgactgtcaccagcctgacgagtctctggacttttcccagcttttggaggctgttgtcatttatattgccaccctgcttgcactggattaaagaaaatcccacgcatcgattcggggataatcaggaggaattgtgatgaataagagagaacgtgtattagcggcactgaataacgaggaagtggactatgttccgggctgtttctggcggcatttcccgccggaacagagccatggagagatttttatcagagagcagatcaaattttacagggatatggatctggacttcttaaaaatatcctgtgacggatattttggctggccggaaaagacgcttataaacctggagagcgccaggcagctttacgagatgaagccgatcggaaaggatcacccctttatacgggagcaggtcgagcgggcgaaagccattgtcagggaattaaagggagaatgctgtattttttacaccatgttctgtccgctgtcttatctgcggctggaggtgggctgggataaaatgatggaatgcatgagagaagatccggatgcggtccgctacgcctgtgatatcatagcggaggatgtctgcagcctggtggagggattactggaggaggccggatgcgacggcgtattctatagtgttcagaacgcagagatcaccagattcacctatgatgagtaccgcagctgggtaacgccaagcgacaaaaaagtgctggcgcaggccaatacgcccgggcattatacgattctccactgctgtggctgggacgcggatgaggcgggaaccaccaaccggatggaggtatggaaggattatgagtcggctttagtcagctgggccatgtatgtagaccatctggatccggtgcagatccgggaattcttcggaggaagagcggcgtggggcggttttgacaaccgcagatgcggagtgctctacaagggggacaaagaggcgatagaggaagagacaagacggatcatcgcgctgggcggcagaaaaggttttatattggggccggactgcagcctgccggacgatatcgatccggaacatatcaaatgggtgctggaaacagcaaggaggtgtatctgatgtatcaggcaaacgaaaatcgttacggacagatgaagtattttcactgcgggagcagcgggcttaagctgccggccgtatcactgggattgtggcataattttggaagcagggataattttgacaatatgaaggcaatgtgttacactgcatttgaccatggaattacccattttgatctggccaataattacggtcccgtgtatggaagcgcggaagaaaatttcggcagaatcatggagcaggagctgcatccgtaccgggatgagctggtaatcagcacaaaagccgggtacgatatgtggccggggccgtatggggatggaggaagcagaaaatacctgatctccagcctggatgccagcctgaaacggatgaagctggactatgtggatattttctaccatcaccgcatggacccggatacgcctctcgtggaaaccatgatggcgctggatcagatcgtcaggagcggaaaagctctgtatgcgggcatttccaattacgatcaggagcatacgaaagaggcaatggcgatactgtcagatttaaagtgtccatttatcatcaatcagagcagctataatatattcgaccgccatatcgaaacagacggattaaagacgtatgcaaaaactcacggctgcggcattatcgcattcagccctctggcccaggggatgctgactgagaagtatcttcatggaatccctgaggacagccggatcagacgagacggacgtttcttaaaggagagtgcgctgactgaaaagcggttgtcccagatccgtgctcttcatgaaatagcggaaggaagagggcaaaagcttgcccagatggcactgtcctgggtattaagagacggtgacgtgacgagcgtgttaatcggtgcttcgaggccggagcagattgtggagaatataaaaataatcgacaggacagaattttcaaaggaggagttggaggcaattgaagaaatctgtaaatgagagagtaaaagaggccatgaaggagcagggcgttgacctgctcctcataacgccatcctcagatatggtttatctgctgggaaaatgcatgatgtcggatgagcgtctgaatgtttacgtggtgccggcggaagggagagacttcctgtttgtcaacgacgtatacggacaggaggtggccggatggggcattccggaaacagaagtggttacgtggaaggacggcgaaaatgcggtctccttacttctggagcagctggagaaaaagaggcttccttacgggaaaataggtatcggcgcatcaatgccggctggattcctggttccgctgcaggaagcatttgcccgaacacgctttgtcctccatcgtgagatcctgggccggatgagacgatataaaaatgaacaggaacagagcctcatggaggaagcctgcagcagatgcacggaagcgttaaaggcggttatgaaggccggcagcggctggattggtaaaacggagggagcgtttgccgatgccctttgcagggagatggagcagcgggggatatcagaggcaggagcccttgtctgtgcgggagcccatgcggcggtgcctcattatacgggaaaagatggcatcatttcagcagatgcgtgtcttctggtggattttggaggcaaatacaggggatactgttcagatatgtcgagaaccttttatttctgcggagagaacgataagagacgggagttcgaggccgtgtatggaatcgtgctggcggcgctggaggccggacagggggcggccgtcctgggcggacggatggaggaggttgacaacgcggcgagacgtgtgatcgctgaagccggctacggggagtatttcacccacaggacagggcacgggatcggaatcgatacccacgaggaaccgtgcgctgcttccggcgataaaagtgtgatcgaacccggactcgcgttctccgtggaaccgggcatctacctgcccggaaaattcggaatccgaatcgaggaccagatatttatgacggcggacggcgccaaagttctccatgactatccacggaatgagtggctggtgtgcgggtgacgggtggtgttttgcaataaggtgcgatatgggcagtatttatatgcagtatttatggcatggaggaaatacaatggattgtgcaaaagtaggccgcttgattatgcagttccgaaaagaaaaaggaatgacgcagcagcaggtcgcagaccttttaggaatcagcaacaagactgtctccaagtgggagcgtggtctgggctgtccggatgtatcgctgtgggatgatctgtccacggtgctgggtgccgacatattaaaactgcttcagggagaattgagtcccaaccgtccggatgtgggcaagctggaaaaaacactcttctatgtatgtcccacctgcggcaatattcttgtaagcacgggaaccgcgtcgatttcctgctgcgggagaaagttaaaaccgttaattccggtttcgtgctcggaggaacataaggctgtcctgagggaaattgacttggagtattatgtgaccgtgaatcatgatatgcgcaaggatcattatatttcttttgctgcccttgtctaccatgaccgtatctatttaaaccggctgtatccggagcagaacccggaattccgactgccgatggtaaggaagggcgggtatttatatatttactgtacacaacatgggctgcagaagtgcccgatcgcgcagatcaccagggaacacgaaaggatcgcggactgaaagagctgttatcagagacggcggttttgagtaaaatcaaaatcgccgtttttttctatttttctgttgacattttcctaaaatgtggtattgtttaactagaaatattaattaattgaattaatacataaaccgaaggaagaaattaattcaaaaataaaaaaagaagaggagaacagcgatgaaattttttgttgacacagcgaaagtggaggatatcagaaaggcaaatgatatgggagttatctgtggagtaaccacaaacccatctctgattgcaaaagaaggaagagactttaacgaggttatcagagagatcgcttccatcgtagacggaccgatcagcggcgaagtgaaggctaccacgacagacgcagaaggcatgattaaagagggacgtgagattgctgcgatccatccgaacatggtagttaaaattccgatgacagtagaaggcttaaaggccgttaaggtgctgaccgcggaaggcattaagacaaacgtaacgctcgtattcagcgcgaaccaggcactgctggcagccagagccggtgcgtcctatgtatctccattcttaggacgtctcgatgatatttccatgccaggcatcgatttaattgaaaccattgcagaaatgttcaacgtggcgggtatcacaaccgagatcatcgcagcaagtgtccgcaatccgatccatgtcattgactgtgcccttgccggagccgatatcgccaccgttccttacagcgtaattgagcagatgacaaagcatccgctgacagatcagggaatcgcaaaattccaggctgattataaggcagtattcggagagtaagaggaggacacgggattgagcgactatctggaactagaaaaaacagccaatgagatacgaaaaggcatcgtgacggcggttcacagcgcaaagtccggccatccgggcggatcactgtcggcagcggacttatttacctggctctattataaagaaatgaacatcgatccggaacagcctttaaaggacgaccgtgaccgttttgtattatcgaagggccatgtggcgcccggatactactccacactggcacaccgtggattctttccggtagaggatttgaagacactgcgtcataccggttcctatttacagggacatccggacagaaagcatattccaggcgtggatatgtccagcggttctctgggacagggaatctctgctgcggtcggtatggcactctctgcgaaactgcagaagaaagattaccgtgtttatacactccttggcgacggggagatcgaggaaggccaggtctgggaagctgcgatgttcgcaggtcacagaaagctggataatctggtcgtaattgtggataacaacggacttcagatcgacggcccggtggctgaggtttgctccccctatccaattgacaagaaatttgaggcatttaatttccatgtaatctgcatcgacggccatgacttcgcccagatcgagcaggcatttgcagaggcaagaaatacaaagggaatgccgaccgccattatcgcaaaaaccttaaagggcaagggagtttccttcatggaaggagctgtagcctggcatggtgccgctccaaacgacgagcagtatcaggtggcaatggcagatttggagaaagcaggtgaagcgttatgccagagatgaaagaacaatccgtaaagaagatcgctacgagagaaagctatggcagcgctcttgcggagctgggaaagcttaatgacaaaatcgtggtcctggatgccgatctggcagccgcgacaaagacgggagttttcaagaaggtatttccggaacgccatatcgactgtggtattgcggaatgcaacatgatgggcattgccgccggccttgctgcaacaggcatggttccatttgcgagcaccttcgccatgttcgcagccggcagagcgttcgaacaggttagaaactccatcggatacccgcatttaaatgtaaagattggtgcgactcatgcaggaatctccgtcggtgaggacggcgcgacacatcagtgcaacgaggacatcgctctgatgagaacgatccccggcatggtagtgatctgcccggctgatgacgtggaagcgagagccgccgtcaaggccgcggccgagtatgagggcccggtttatatgaggttcggccgtctggctgtgccggtgatcaatgataatccggagtatgaatttaagatcggaaagggcgtagtcttaaaagaaggcagcgacttgaccatcgtggctaccggtctggaagttggccacgcactggaagctgcaaagcttctggccgcagacggaattgacgccgaagtgatcaacattcataccattaagcctctggacgaagagcttatcgttaaatccgcgaagaaaactggacgcgtggtgactgtggaagagcactccatcataggcggacttggaagcgctgtctgcgacgccctgtccgagaatgctccggtaccggtctttaagatcggcgtacgtgacgtattcggcgagtccggcccggctgcggagctgattcataagtatgaattggatgcagagggaatatataagcagattaagagtaagtggtattaaaagaaatagcagcaagaacagcaagaacagcagcaggccgtgatatggaagagttggttcccgtatcacggcttttttgtgtgaaaggagagcgaagattttacgcaaaggcgattaggcaagagggctttttctgtattgtggatcaagttcataaactgcacatggagactcgtgtctttagacatgagaggaattgtgcccgtcctgactctttcgcgagccccttctcctttttgttttttagtttttcaaacatttgtttgctttttacttctatatgtagtaaaatgtactcggtccataaatctattatgaggtataaaatctatgaaatctattactattactgctaaagtcaaactataccctacatcagaacagatgattattttgaataagaccctgtccgttatccgggatgtgctgaactttgtctccgcattcgtttttggacaggaaggcatccgctatctcgaattaaaccatgtcttatactatccggtcaggcagcagtttggactccgctctcagatgacacagagtgtatttaagaccgtccttgcaaaatataaatccatgaaaagcaatggacaccccttttcgaaagcatcttttcgaaacttcgagtatgatcttgtctggaaccgggattactccatatcgggtcagtccattagcttaaataccctttccggcaggctgcatatcccctttgaattaaaagggatggaacactggtttcgttccggcggacactttggcactgctaaactgattcggaaaaacaggaaatattatctgcatattccggtcaccctggaagtagaaagtatgaacatcttaaaccatatcgttggaattgatctgggtgtgaaccatttggcagtttcctttgatgaggaagggaacaccaggttcttttccggccgcgcagtcaaggaaaagcgcgcgaaagcacttgccctgcgaaaacgcctgcaggcatgtgggacaaaatcagcaaagcggaagctgaaaaagctccgtgagaaagaaacccgttacgtaaccgcggtaaaccatgcggttacgaaggcacttatctcacagtatggagccggaacgctttttattatagaaaatttaaccgggatacgcactgccacagaacacgtccgtttaaaatcccggtacgtcatggtctcctgggcattcgatcagttccgtgagatgctggaatacaaagccgcgctgtcacagtcagaagtacttgcggcagacccgaagtacaccagccagagctgtccggtctgtggtaatacgacaaaggctaaccgtaacagaaagaggcatgaattctgctgtactgtatgcggttaccgaagtaatgatgaccgtaccggagccataaacatctaccgtaaaggatttaacactctgttcgcagaggcctgttaggcagaaccgaagcaggcgggctgccgtcaatcagcctattgtagccaacgtttgaggtaggagacatgaataacatgtcgtactacgtgtagttgagttacaagcccgtgcctttagacatgggtaattgacagatttgtaagaaaaatataaaacagcatgcattgaaattgtgagagtatagtggtataatctaagtaataagtaataagtaataagtagtaagcagcaggtatcaatcatcaaaaatcaatcaacaagcacagcaggcaaacatcaattggcgtaagccgaaaggagatatcctatgaatgagtatacattatcacaacaatacgccctggttggtctggatggccaggattccatacatacaaccacggccaagagtgcggtctgccgcggaattgcggctgcaaagcttctggagaggcttatattatcggatcatcttgatttagaggctgtaaaagaggaactggatgcaggatttaaagagattcgcggcatcggcaggaaggaagcccacggtctggagactgaaatggcggaagtattgaaggccaggggcgtcctcgatgagataccggatattctggcgtgcgatattaactacagcagcatgaatatggacctcagaacctaccgcagcgacggaacagaataccagcgtatcgttgagggcgtccgtgctgaaatcctggaggacggcgcggtgaccctggaatgcgcatgtctggtgtggctgttccgagagagcggatgtatccatgatatattttctgttcaggagcaggagagactgtctgcccgtatgattgaactggccgcgcaggatccggttgtcagagtggtctggaattcagacatttaccggtggacggaaaaattgtcgcagcagctgctgggtgcgaaaaagaacttctttaaaaacccgtatatggagggcgtcaatttattatttccatttttggacagaagacaggccgttttcattgatttcgttgttcttggaacgaatgtggcgggcaggcgtctggcaatgatgacctatctctccgaaaagggccactatgtagaggaagccaagaatggctcggagacgctcttaaaggtagataactactattaccgggtattcccaatgacaagggtctattacaaaataccagttcagggggcgaatctggttccggtttacaggtaggtgatggaatgtcaagacagagaagcatggaaaagatcagcagctctgagtatgtgtcgatcggtgaactatccagacttaccggctgccgctacagtacactgaagtattatacagaagagggcatgcttccttttgagcaggaggaagagaatctcacaaggcggtatcggcgggtcgagactgtggaacgaatagaacggatcaaaagactaaaggaaagcggaaagacgataccggagattaaagaattggttaaagaataaatgacgaagacgcgcagatcccgcacatagacggctcaggaatggcggtgcgggatttcctgtgcggaaaataagccggggcagaccgggaagcagaggccgacagggctgtgaactgtaacgcaagtcagaaagttaaaaaaatagtcattgacatttttagaaatccgttttatagtatccatagaataaagagggcgtacagtcctttatgagcaaaggagtggttgttatgttggcaaacgaaatgaaaagggtgaaaataagataacgatagaatagacagggactggcgtataatagctttattttgctgcgcacggcttgttgtcgtgttttttttgtaccatttttcgagattccggggaaatgggacgtatggccctgtcggctcataaaggagattatgatttggaaagagaaaattgcatattgatcagtaacggtaaaaactggattgaacaggcggcgatcgaccagcttcgtggagtcgcgaatctgccgggagtggtgaagacggcagggctgccggatctgcacccgggaaagactcctgtaggaatggcagtgttaagcagggagaggttctatccccatttaatcggcaacgatatcggatgcgggatgagtctgttttccacaggagtgaagcagaagaaattccggatggataagtgggaatcaaggcttaaccagattcgggagctgagcgatattccgtgcggcaacccttatgatgaagtttgccccgtcagggatttgggaaccatcggcacaggaaaccattttgcagagtttcagtgtctggaacacgtttacagagaagaggaggccaatcgcctggggctgcttcatggacgccttatgttgctgattcacagcggttcccgaggatatgggcaggagattttaaaccggtattattcgccggaaggactggcggaaggctcgaaggaggcggaggactatttgaaggaacacgactcggcgattctgtgggccgggaggaatcgcatagtgactgcgaaaaagctgctggcctggctgggtgtggagagggatgtaaccccgcttttggagagctgtcataactatctggaacggacggaggatggctggcttcaccggaagggaagtgtatcgacgaagcagggagccgtggttattccgggatccaggggaagtctgacctatgtatgtgtaccggcagcggacacgtccgtttccctggactctgtgtcccatggcgcgggcagaaaatgggccagaagtatctgcaggagcaggattgaccagaaatacgacagggattccatcagaagcacaaagcttaagagccgtgtagtctgccatgataccaatttactgtttgccgaggcgccggaggcctataaaaatgtggagcaggtgatcgcttcccttgaggattacggactgattactgttgttgcgacgctgcggccgcttatcacatttaagggttagggggctgcgcatgagaatacagataagttccggccaggggccggcagaatgtgaactggcggcaggcctgttctatgaggaattaaagaaggaggctcccgatatccggctgatttccttcacacagggaaagaaacgggagggattttcctcgattgtgtttgagacagaacacgattttaccggcctggagggcagtgtactgtggatttgcaggagcccgtaccgtccggagcataaacggaagaactggtatgtggatgtgagtattttagaggcggtgccgcgggtgacagaggagaaactggtccgttttgagacctttcgaagcggcggaaaaggcggccagaatgtgaataaggtggagactggtgtccgtgccatccacattcccacaggaaccgcagtggtatccacggaggcccggagccagcatatgaataaacagattgcattgaaccgcctgtgcgaaattctggcggaaatgaacatggaaagcggacgaagagaaaagaatctggcctggatggaacatgccagactggagcgtggaaatccggttcgggtatacgagggaagatcgttccggcttaagacggagaaaaatgggggataagacagatggaacaggagacaagatgcggctggtgcctgatcaatgaaccgatgatccagtatcatgacagcgaatggggcgtaccgtctcatgacgacggaaagcactttgagtttatgcttatggaggtcatgcagtgtgggcttaactggaacatgatgatacagaagagggaaatattcagaaaatgcttctgtgactatgattttaagcggattgcagagttttgtgaggaggagatcgctgaaatccttctcgtccccggcatgatccgttccagaagaaaaatcacggcagtcatacacaatgccagacaatttatgaaggtggaggaggagtttggcagcttcgaccggtatctttggggctttacggattataagacgtacgtttaccgctggcatcaggagggtgaggcggaagcgaggaacgaattatcggatcaggtgagcgcggatttgaaaaagcggggctttaagtatatggggtccatcacggtattttctcatctgcaggcctgcggcatcatcaatgaccaccgtccggattgtttcaggtatgaagcgctgctgaaagagacggaatgggagtatcggtaagagagagggcagaagggcatttgagatgcagaccgatagaatgaatagaaaatgaaaatgaaaatgaaaagcgaggtgccagatggcaaaaaaggaaactgtaacgcaggaagatttatttgaagtgcttgatatgatagaacagctgggaatccgttactggctggatggcggctggggtgtggatgcgcttgttggaaggcagacgagagaacacagggatgtggacatcaatttcgatgccgcgtgcaccgaaaaattacggcagaagctggaagaaaaagggtatgaggtagtaacagactggagccctgtccgtatagagctgtatcatccccaattgagctatatcgatattcacccattcgtcttaaaggaagacggaacagcaaaacaggccgacttagaaggcggatggtatgagtttgaggccgattattttggcagtgccgttttagacggaagagagataccgtgcatctcagtgaaggggcaaaagatttttcataccggctatgagccgagggaagtggataaacatgatatgaaaaatattaaagaactgatgagcgatgtctcgtaaagcgggcttgatgcagcaatttaaaggataaaaaacagcagggagcgacgatatcgatcgtcgttcgcctgctgtttcgttatgatacagatgtacggcacaacatacaaaatgcaacctcccaaggtctcgccgcaggcgggcggaaattcacctctgtttattcctgcggcgtgatatttgactctgttcgtattccagaaattccctagtccggctccagtaacggatgccccagttttcaaaattccattcttccatataatcgttgcactcataatcaatataatacagtgcgtcgttctgaaccacaaaattggcaggaaagtaatcgatattcgtgtttgccgggtagagcctgccgcacatatcctcgatctggcggaaataagccggcttcaccggatcgcaaagaaccagatcgtcgtataacgtatcataagtccttgtgcatatagcacgcgctatccacaccagaactgtgcctgcgaatatcaggcactctatgcacaaggacttacaatacgttatactagataggagtagccgccttttcccttacccaggaggcggataacccggtattccttctgattgactgtcaatgtctaaggcatgcgaccgtcttccagcttctcgatgaagtggaccggatacttgttccagtattttttgtagacgcggtcctggtctccgtcaaaattaagctggtacatccgaaatatcaccagaatatctttgggctgccactgctcctcataagagtactgatagatcatgccgatcttctccatgacccggccgcttcccggattctcacggtcatgagtggcggtaatgtagggtaaatctgtggttgctagtttccggatcagcgcccggctggcttcggtcatgattcccatcttccagaactcttttttcagaccgtatcccaggtcgtggctgtcgtcatcgctgacgttgatatatccgatggggatatcatctgttttgaggcagaccgcgtagtggtaaccgctgggctgctcgtaagtacttaaatagtgttctttgagatactgcccggcctcctccagcgatgtcagcgggaacatgggcagaaactgattgacttcgggatcgctgagtatggtgaacagcgcttcggcgtcacgctctgtaaatcggcgcagccgcaggcgttcggtttcaatgacaggagtattatccatgtgtgtctcctttttctgatgattttttattcgtgtaagggtgaatttttctttacccagtcttaacacactctaatgcccccagagattctgcgccacctgtacggcggatttatctgcgatttccgcgatcatttctttggattctttcatgccgttgttgatccagcagcgcagaactccggtcaggccgaaggtgatgaactcgatgaaataggagagcgtcacatcgtcgattccgggatactgtttcttgaaaacagcggttccgttgtcagaaatgagctggtggaagcggttgacgaaatcactggatgcactgttttcaaacagaattctggcaatttttacgttttcttcaatatattgtataacaggcagcaggatgggcatcagcgatccgttctttggactgcacaggaaattatcaatcatatcctgaaaatcagccagtacgtcggattccatcttctgcagcagatcgtaagtatcggtgtaatgattgtagaaggttcccctgtttagatccgcccgttccgtgatgtccttgacggaaatatttttaaaatctctctcggtcatcagctcaatcaggctgtcttttaacattttctgggtcctgcggattctccggtcctctttctgtgattccatattcttctcctcacaatcctgtttaaaaacaaaatttatcagtttcgattgatattaaacacaaatgcaaataagtgatgtttaacgtacaaagcagcgaatcgttgcttattgaaatataccgacaagtgaattataatacacatgtgttcaaaagtcaatgattgtacaataatcaaaaggtgggcaataatgaaaagaaacagcgatattttcaatcaggtgattcggtttattgtgtatcacgggaagatcattgagaaggttttcctggtaaccacgattctctgtgccatttgtttcccgtttgtaggggtgaattatgatctgagcaaatatctgccggattttgcaccgaccaaacaggcgctggatgtgatggaagcggagtttggctatcccggcatggcgcggatcatggttaaggatgtatctttacaggaggcgaaacgcatccgggaagaaatatccgcggtcgatggggtggatctggtactgggctccgacgtctcgaccgacgtctatatgggagcgccgttccttaatgaaagcatgacggagttcatcggcgtcgatctgctggcaatcgatgattactataaagatgggaatgccctgatggacatcgtctttgaagataaagacggagaaccgcgcaccaatgcggccatcgaagagatctaccggatcgttggaaaggaccggggctgttttgcaggaagcgcagtgtccagcaaggagcgtgaggcctcgatcaccagggagatcaccatggcgattgccatgtcaatcgttatcatatggctgatcctgacactgacgaccacgtcgtggatggagccgttcctctttatcttcgtaatgatcgtggcgatcgttttgaatatgggatcgaacatcgtcttcggaacgatatccttctttaccttctccacggcggctattctgcagctggcggtgtcgatggactactccatcttcctgctgcatacctttacggccctgaaaaacaggggcatggagatccatgaggccatggtggaggcgatcagggaatcctgcagttccattctcgccagcggagcgacgacgatcgtgggattcatcgtcattgcatttatgcgttttaccattggtaaggacgtcggattcgtcctggcaaagggcattatatgcagccttcttaccgtacttctgctgatgccgacgcttattctccggtttgacgacaagatcgtgaagacggcgcataagccgcttattgcctcatttgatggatttgcacgggccatgtacaagatccgggttccggtgttcctgttagcggccctgttagcggttccctgttatttcggccaaagtatgaataagttcctgtacggcgacgatgccatcggcgcggggccgggaacgcgggtctatgaggacacgcaggagattaacagcctgtttaaaaagtccaatatgacaatctgtatcgtgccgaacggttccagtgtgacggaaaaagaactggcgaaggaactggagaatctggatttcgtcaactatgtgatttccatgtcgggcaccatgccgaacggaattccggaaagctttcttcccgaggatttaaccagccagcttcgcaatgaggattacgccagaatgctgatctccatggatacgctgcaggagagtgactatgcattcgagtgcagtgccagactggaggaggtcgtacataagtattatcccgatcattcctacgtaattggaatgacgcctacaaccatcgatatcagggatattctgacggaagattataataatgtatctctgctgtctctggccggtgtggcgctggtagtattcattaccttccggtcgatcctggttccgattctcgtgatcgtacctatcgaagttgccatctatttgaatatgacgctgccctacgtgatgggggacagcatgatctatatcggctacataatcgtcagctgcctgcagctgggggccaccatcgattactcgattctgatgacaaacaactatctggcatttcgtaaggaaaaaggccgccgggaggctgcggtcgccgctgtcaacaagagcacgctgtccatcatgacatcgggcggtattctgatggtggttggctatcttttgtactttacttcgtccatacaggcgatctcccaggtagggcgtctggtagggcgcggggcatttttgagcgtgacactggttctgtccctgcttccggccctcctgtccgcatttgataagcagatcaagcggcagcaggagaaagcggatgcacggaaagagagaaggcggaaacgtctggcggcggctaaaaatctgacgggggcgaggaatgtggcgtcgaagaagagtgaggtgccggagaagaacctgacaccagcagagcgtccggctcccgcggcaggaaaaggcagtccagaggaaaacataactccagcgcagaccggagagtcagatcagaaggaaaagggagatgacagccatgaggaagagtaaacggatttcagcgtttgttttagcagcagtgcttgcatgcggcccgactatggaggcgggagcggcggcagacaccccggtctgcgatgagacgctttatatcaccatggacccctatggggagataaaagagagcagtgtcgtaaagagctacaccacgaatggaagcagccagattgtcgattacggcacgtacaacagaattaccaatatgacagatcacgccgaaccggtgacggactcggagggtaagcttactttcaacctggaaaattcgaaggatcgcttttattttgaaggcggcacggataccaccagggaagaactcccctggaatatccaggtgagctaccgcttaaacggactggagaagaaggcggaagagctttacggcgcggccggcctggtggaagtaaacgtggatctgacaccgaataagcaggtatcggattattaccgcaataacatggttctcatggctggaaccgttgtggatatggataaaaacctgagtctggaagcggaaggcgctcaggtccaatcgatgggaaatttaaacgcggttatatttttcgcgcttccgggagaagagcagcactactctatccgcattggaacgaatgatttctctttcagcggtgtcgtgtttaccattgttccgctgaccgcagcccagctcgataaggtgggggatttgcgcgaggcgaagacgaccctcgaggactccgcggatgccatcagcgacagcctggacacactatttgatacattcgacggcatgcagaagagtgtggaagatacagccgacggcctgcgcggactcgatcacagccgccagcttttcgcagactccaagggtaaggtatacgccgacgctgacgaggctctggctggcctaaatgaattgtcccagcagtttgaaccattttccgggcatatgaaggaggcagaaaaattcctcgataccatgaattcccatgtaaatgagctgaccggccatctcgacgatctgtcgccggatctggaggacatgaaggccaccatgcgggatctgagagatgatttacggggaatcagttccatgttaaacagtccccaggtggatttgggagcacaggcatttctgcagctgatggaaaagacaaaggcagatttagagaccttcaaacagtcgcaggcaaagctggatggcggtgtgagtgcgctggcgcctgcacttgccggactggtcgcatcgaccggcgggctgagcggtaaaaaagcggaatatttcagtgaggacagcctggaagatttaatcggcgagatggagagcgcaggcgtgaatctgggagatgaggatgaggtcgcttcctatttaagaaatgaggttggcatggccaccgatgagatcgatgcgctcatgagatatgcgtcccaggcactatatgagaccgctactgcatcccagccaaacacgggtaatatcgccgctgcggttggcgcgatcgtcgaaggcttccatggcactgcgggaaacaccggactgattacggatatacagaccatgatcggacagacagaggtccttttgcaggcagccgcctcccagaagggaaatgcggtgggattgctgcagaatacggcggatatgtcccatctggcagccagtatgtgcaacacgctggacgatatcatttccgatgcagacagcctgaccaagacggtcaactactatcacgaggatacgctggatactctgagggatctggggaaaatgacagacgccgccgccaggagcttaaaatccctgaccgtgttctgcacctcctttgaaaaccagatgaaaacggtgggcgattccttaaacgccagcacccagaagacactaaacggtctggcaggaaccctggatggaatgggagacggactggaccagacagacgtgcttaaaaatgcaaaggataccatcaaaacgctgatcgacgataagtgggatgagtatacgacaaaggataccaccattttgaatatcgatatggacgcaaagccggtatccctgacatcggagaagaacccgtctccgcgcaccgtgcagatcattctgcgcaccggtgaaatcaaggaaaaggataagagcaccactgcagaggtggatgagagctaccacccggagggaaatgtgttccaccgcatcgccagtatctttacgcggatctggaatatgattacgtcgctgtttcataaataaagagtagtgagaaaaggttccggagctgttaaaagcggccggggccttttctttatgggatatctaaacatcgggcgcgatatgacattgcatttgacagagatgcaggaaggcattaaaattgatagaatataaagcatactcatatattaacaggaatcgacgtgagctgtttcgggaaaatacgtgatagtttggaggatcagagcacgtatgaagcggcaatcctgtgtggctgcccgatcggcggcctcgaagtgtatttttaaggaaaacatggaatactaccagtaaaaacagggcataaagacgggagaatcatatgtgcggacgatattatgtggatgacgagacggcgcgggagatcgaaaaattagtggaaacagtcaatgacaagcttcgtctggagcggctgagaaaggatattcatcccacagatgaggcgccggttctggtggcgggggaccgggaaatgaagctggaatggcagcactggggctttcctaattttcaggggaagggcgtgatctttaacgccaggtctgaaacggtgctggaaaagaagatgtttcgcgagagcattctgcatcggagaattatcattccctgtacctggttttatgagtggaaccggaaaaaagagaaagtgacattttaccgggaggacgctccggtgatcttcctggccggtttttacaatgtgtttggagacgaaaagagatttacggttttaacgacggaagccaaccagtcgatggtcagcacccatgaccggatgccgctcatcgtcgagccggatcagctgaaagactgggtactggatgacacaaagttcagtggaatgctgaaacagaccccggtgctgctggagacgaaacaggaatacgatcagcaggaactgaaatttctatagcaatttacggcagaaataagcatatcctttacaaagagtctgaagcggagggggatgctggtgaaacagacgggcaaatatctgctcttgtttgtaacagggggccttctatataatatcatagagattttactgcgtggctggagtcactggaccatgttcatactgggcggcgtctgttttatctgccttggtttgatcaatgaactgcttccgtggacgctgcccctgtggaagcagatgcttctgggggcggcgatcattacatattttgaattgattacggggtgtatcgtcaatatctggctggggtggaatatctgggattacagcggactgcccggtaacatccttgggcagatatgcccgcagttttccttcttatggctctggatcagccttgccgggattgttctggatgactggctgagatactggcttttcggagaggagcggccccgttacagacttgtatgagacgaccgctaacgtgagccggggcacgactgtccacgaactgtcatatgatatcttagaaacgcttatgtttgcgcatggaaggggcggctttcagcagtggaagacgtcagactcccttcggccggaaacatgaggaaaggagataatcagatgaaagatatcacattgtgccatccacgtctgcaggtattggccgccaatatggtggaagaatgcagaaaacagggactggcagttaaaataggcgagacgctgcgaaccagagcggagcaggatgcgctttacgcacagggccgcacaaaaccgggcagtatagtgaccaatgcgccgggaagctcttacagctcgtttcatcagtggggaaccgcctttgacatctatcgaaatgacgggcagggagcctataacgagtccggcggctttttcgaaaaagccggcgcggtaggtgtgtcgctgggcctcatatggggcggaaactggaaatcgatcgtggacaagccgcattttcagctggccgattggggcagctccacggatgggatcaaacggctgtacaaagaccctgctgaatttatgaaaacctgggttacgggaaaggcaaagacaggctggattgaagatgtgtacggccgctggtaccgccatgacgacggaagctatacgaaaaatgactgggaaaagatcgacggtaaatggtactggttcaatgaatcgggatatgcctaccgcagtcagtgggtgctgagtaaagagaaatggtattatttaggcgaggacaatgccatggttacaggccttcaggtggtcgataacagcgcatactattttgatggaaccggggcaatggctaccgggaagattacgctggagacagacgaaaagggagcactgcgcggctgagaagccggcggaaaggcggcaggagattttgaaactgccgcctttaaaaggtaaaagatcaggggacaggagagtgattgcactcaggatttctcagataaaataaacgtctgtatatatttatccatattagagaaagcctgctttttcaactgcttctgaagaaaaatcagcaggacacaaaccgctagaccccatagcccgccaaaaaagccgggaagcgtaaaactgaagatgccgatacatgaaataccggccagaattataaggataagcgcgtgaatgaacgttaaaaacctgtcccttatataggttaattcaagcagagagtcggagcagtctacgcgaaatgtgcagtgaaaccgatagattccgttttctatagtttttatcgttctgattccggaaattgaatttttattgtggtaacggcagattacgtaccaggagtccatacgtgctgtctgcggagaagagaagcgtttcaataattcccattctttcatgtgacaatggtaggttagttgtgatttcataagatctccttattggaaattacatgccttcgcgaaacaaaggcaacattatcttttccattccattggcgtaaacctaaggctattaaccgtctgctccgtatcggtaccatggaaaacttataagctccaaacatacggagacccacctttcacttttattccagcatattaccggataagacaggtatcgaactgattaaaacgattttaacatacaatgaacgaaatggatacaaaaagtgagggcggtgagtagagaagcctgtcatattgaaggtgtgttccccttattttgtaagagatttcataaaatttatactttctcctgcgatcacatccggcatttcgtcgtgaacgtagtggccgcagtctaaaaacatatagtgggcattctcaaaggatgaaagataatctgttacagtatcccgccagccgggagctacctgggaaccatcggaaatgaaatagtaaacagggatttttacgggtttacccagactgtcaacgtttacggcattatcataacaggatctggcctcgtcagccatgctgccggtcataaagctgcgcataacaaccgctctgtacattgccttttcttcatcagataagacatccatagtcatggccgggtccgtattgtagatttcaggctgaagccgcaccagaccggaccggtaaaagaacgaaagaagtttcatatgatcggcggtgtcctccagcaattgctttccccaggaaagataaagggtgggcactgcggcatcaaggccgatgatggcttttacctcatcgggatatttctgtccccaatagagcgcttcgatgccggacaaagagtgaggaaacagaatatagggaccattttccccggacagcgtcagggccgagcgtgtctcctccagcacggtatcgatatccctgggaatgtcagcggcctcgctgaacccataaccggctctttccacgactacgatgtggtactgatcgcttaatctgctgtagagcgccttaaaatccagagcaggggcagcagttcccgagccggacagaaatacaagtgtttcattgccattgccatcgccttcgccatacacatgcatctggtggccatttacttccaccatttttccgacaggcggatattttctgctttcggcccatagactgattttatgaaagccatataaggccccgcagaggattacaggtactgccagcagaaatagtataattcttaggattcgtcgtcttaaacgcatttgttattacctcctcaaccattttagtctatcacataaggcccggttgctgtaactgcctgacggtcaactttcggttgcattgactaatatatttccattgcagcgtgacattggggcaatctgcatggtttgcggactctgaaagcagagacggcaatttgtgattggctgattctcatgtataggctataatagaatccagaagtgtttaatcaatcacagaataaggaggctcaaatgaaaaagaagtttgagagctgcggacattcttttgacgcagaattttttccggccgaaagctcttgtatgatccgtttctatgacagcaaaaatgaagactttggcggttctctccatgatttggtgattgcagaaccgagttacggttttttgcttgtacagtatttcggcgatgatgctgttatgagcggagtgttaaatgaaaagtattttgcgaaaaatatgacggaggatatcctctgttttctggaggacagtctgccgcaatgccgaaatgtctacttcccgtatcatatcgattttgctgcggttaccggatatgatgagtacaatggggagtattctgcctgagcgatcgggcgcgatttgcagtttccagcatatggttccccatgcgccggacgaagtccgttcagagaatcgtaaagaatcagaaatagtaattccttaaaaagtatgataggatagtggtatctggaagaaagtgacagcgatcagaggaggaatggagtatgtggacaagagcagagttaaaggacagggcaaagcaggatatgaagccgttttactggtacggtgttctggtttgtttcattgcgggaatactgggagcgggaagctccggcggaggcggcagtatcagcgcaggcagccggtcgagccggaattcctactcgggcagcggcgtatgggatgagcacagcatgacaatttttctgatagttttaggggttattctcgttgtaatggctattgccattgtgatcggcatatttgtgagcaacctcgtagcagtcggtaagctgcgctactttatggacagcgccattatgcagcagtcggccggagtcggacgtattttcttcgcgtttggcggaggccactatctgaatgttgtgaagaccatgtttttgaggggactttttgaaagtctgtggacgcttttgcttgtaatccccggtatctataagcactatgaatattacatgataccctatctgctggcggataatccggagatggaatggcacgaggcgttccggctcagcaaagagatgatggctggcaataagtttgatacatttgtgctggaattgtcctttatcggctggtatttgctgggaatgctggtttgctgtattggcggtatctttgtgaatccgtactatgagatgacatttgtggaactttactgggttctgcgggatcaggtgatggggccgcagccatcggagccgacggatcagaatgtatatgccgacgcgtattaccgggaaatataatataacagtgattgagaaatcggacagatccatactgtctatcatgaggcgggaaggtagaaaatacctttcccgccttttttgtatactccgaatgacagcatacagtttttttaggccatcataggctgaacaggcgagttttggcgggtcgggatatgcagcaaataaaaagcacccggctaattcggatgcttaaaattgaattcaatttgattgtaatcctctgtttcagccacaaaaggtttgccgaccgacagcttttcgttgatttccctctgcgttacgtaatattcatttctagccttcattaagatcgaggcgcgggaatcctgagatgagttttggaaccagtagagcagcagcgactcttcttcagataacagcttttcaactacggttcctgcttcttcgggtctcaatgcagtaatgagaggttggttcagttctggtaaatcaaatagattgtagatcgtcgttcccagtgccttcgcgatggtctccatgtaagcggtttttacattgatgacagttccgttgataatacgattaagagtggtagctgggatacctgttaaagcggataactgtgttttattaatatcctttagcttcatatacattaatattttattgtttaccatttgtgcaaccctccataatggattatagcagaaatggaaaaaaatgtaaataaatgtcgaatgaatggatggggagaatttccccaggctgtatatttttcttactattaagtgtaatcccggctcgggatggattcttttgacggtaaaaacgtttcattacatttccggagcctatccattacataatggattcggaaaaatgatttctatgatatgattactaaaattaaattcagaggaaagatggaagaggtatggcaaataaaaaaacgtaaagacaaagagtgatcatgattcaaaaactgtcggaggattcgacaggacaccttggaaatgcagggcaaatatttcagttaattcaggaggaatacagatgagaatgaagaaaagaataacaatactggctgccgttacggcgatctgcctgcttggcagcggatgcagcgccataggcggaaaaaaacagatttcggatgtggatgtggtaactacggtgctgaatgcatatcagcagggagattatgagagcatgaagccgtatcttgatgaggatagtaaatttcatccgatgcttgccgcggtaacggcagaaaatgcgaccgcaatggataaagtgtatcaggaagcgtatgcattgacaaagaattttacttatacggccgaagccgtggaaggggaagaaaaatggggccatgtcaaggtacatattcagacgaataacattgtttccggcatttccgacagcatggccgaagcaattgcagagcaggttaaaaatggcggcgacagcttctatgatgtccccacatggctgatggccggcttaaaaagcggggaagcagtcgacgaagagtttgtcgtaaccgttactcttattaataagaaaaaaacgatcagtacccaaactggggaattattcagcgttgtcagcggcggtttttccgaatacatgaatctgtccatgaccagatgcaccgacgagggagagcagtacgacattgtttccagtggtgatgagatcaaggcaatgctggaagaaagcgtggtagacgccgaaccggaggaactcacggaagagtatttaacggcctttgcggatacctttgggacacttcccggtgtatttgtaaaggcagaagtcaaggatgaagaacacctgctgatccgtcttggctttaatatggatacggccagcagcaaggacctggctgatatgggaattatcagtgaccgccttacgaccggtggcggtcatttgagcctggattccacaatccgtggatttgaagagaccgggatgacttgtgtgacagaagactatagtcagacaaagagtgacagtgagtaacgattacgggtttaaccaatagaacagactatgaagataacagactatgaagaaggaagtgcagaatcgcttttggctggcgatactgcatttcctttattttatgatattgagatctgaaactgaggttataccataataaagggtaacattaataaacctgtgacctacaacgagtttcacaagcaagaaatgcaatagggattacctgctcttttccggagagtagagttggctcttgtccagcagaccatagagcagacgtataaatttacgggaagtcaacgcgagtgctcgcttaagctgatggtttcttgtttcagcatatttcttttgatagaagcgttcatactcaggacaatgcctcaatactttgcaagggcatcggtattttgaaaagccttgacagaaccgatctcagcaaggcaagtgagtgtcggatcgttacttattacggaaaaaggaaaatgaattaaataattatctcaggcactgtggtttacaggattggaccctgttccctatttcatgaaaagtaacaagtaaaataaattaaaatcaattatatactaataatgcttgacttattttgatttagtgtttataattgataatagtattagttatcgttatttaaaaaacgcgtaattacaaatgacaaggaggttttatatgagaagtatcacgaagttggatttacagtatgcacacagattttatggttttaagggtgaagctcagtatctgcatggacacactggcatattgacgctggaggttgaggacaccattaatactggtgtcaacatggtattcccctgtaatgagattcagaaaacagcatgggacgttttgaaaaactttgaccatgcaacgattttacgtgaagatgacccattgcttccggctcttctaggggtatatgaggcccagggcattaaagacggagctcctaccaatatcatgaaaggccctgctttcaagacagaacttgcaaccgcgtatccggagtgccgtctagttgtgacaaaagagaccatgacagttgagggcatgattaaaattgtttatgatctgttgaaggacaaattaaacattgtgaaaataacctttacaagcggagtgaatgcggcatctgaggaatttaacccccaaatgaccaaggatcgttgtccattatgtggtattgcattagatgaaaatggagtttgtccgaaatgtggttacagaaaaaagaacgggaacgtgtaacagaaataatttaacaagtattcggaaatagaaattgccgtggaaaaatttaataactgactcaagatggatattgaaaaaaatagggaatagaagagtactaaactcagctattccctatttttatttaataatagcctgtataatataatttaaatcaagggggagaagcgatggaagaacaactactgcaacaaataaaatattatctctcagggaaaatgactaaagaagagtatgctgaactaagtgaaggatatatcactcattacggtgacaagctgaaaagtaaaaatgccgcgttatataagaaattcattgaattgataccagaatgaaaaagtacgatatatataagccaagagcggaaaactatagaaagcctttccgctcctaacattatcttagaagatctgcttttacagagatttcttcacacgcttgccagtttagatctcaaataacatttacagatttattttatatactctagagtcttggttctcatcgtccttcatgagtttatagaaagaatagccatacttttcatataatcctatatgatttgtagaaatatatatatgcgttgccccttcactagctgcaacgtttttagcatactccaatagttttcccagatatctatgccctctaaattcgggaaaagtatatacaaatccaatccacggagttaatgaagtatcccttacatcatcctgttctgctaaagtacaaaatgaaataagtgtttttccttctacaagcataagaacttttgttgagtttccacacagatccagtaattgattgttgttcaataatctatataagtattgtccagctccccaatcacttttgccaatttcttctttccaaaatattttaccatctacatcaaaatagtttataatttccataataattcctccctcaaacgtaaacaaaattttaaaactaaaaaagccccgaaacactagcaaacatgcaggtttcagagctttaaaagagtagcggaagggagatttgaactctcgacaccacgggtatgaaccgtgtgctctagccaactgagctattccgccatatgaaattgtttgataaataagtagtttatttatcagtgggacctacagggctcgaacctgtgaccctctgcttgtaaggcagatgctctcccagctgagctaagatcccatgcttgtctcagaactttttgtttctgtgttcccgactgctttgctagtataatatgaattgtgtaaattgtcaacacttttttggaaatatttttaagaaaattttattattcattttatatgatttatgatatacttaagattagcaaatggtggagggattccatgtactattttatcataaacccaaacgcgcggtgcgggcgggggaagaacgtatggaaaaaactggaaaggattctggagcgtgagaacgcccagtatcaggcgtatataactgagaagccgggagatgcgaaggtttttgccagaaagctgacagaagggtgcagggaaccgcacgtgatcgttgcagtcggcggggatggcactgtcaacgagattctggatggtctttctttctgcagccccgttaccttaggttatattcctgccggttcaggcaatgatttagcaagaagcttgaaattgccgagaaaaccgggacgctgtctgaagaagattctgtctccaaagtaccataagcagctggattacggagtgcttacatatggaggagatgagatttcctgcagaagatttatggtcagcgcaggcattggcatggatgcggcggtttgtcataacattctttattccaggacaaagggaattttaaataagcttcatataggaaagctgacctatcttctgattggtgtcaaacagctcctgcttgcaaagcccgctaagggttatttgctgttggatggagttcagaaggtggagtttaatcatgcctattttatttccgcacatattcatccgtatgaaggcggcggttttaaatttgcgccggatgccacctatgacgatggaaaactttccatttgtgtaatgaataacagaaaaaagagaaaactaataccggtgcttttaaactccatgtttggaaggcagtcccataataagggaacccggttttatacatgcggggaggctatggtccacgtggataagccgatggcggttcatgtggatggagagagctgtttctgtcagaatgacatacagctgcgatgtatcaaaaaggcggtccgcatgattgtttaatattttaaattataatccgggcagccggataacatggcagcatagctgctatatcattctgggttttgtattatggactcagaatgtggatagatataatatacagatttcagaaaggatataagatatcatatgagaatcggacagggatacgatgtacacaaattgacggacggaagggatttgattctcggaggagtaaaggttccctatgaaaaaggacttttaggccattctgacgcggacgtgttagttcacgcggtgatggacgccctgctcggcgcggcggcgctgggggatatcggggaacattttccggatacggatccggcttataagggaatatccagcgtggaactcttaaagcgcgtcggaacgcttctggaagagaaggggtacgtgatcgagaacatcgatgcgacaatcatcgctcagaggcccaaacttaaggattacagaccgcagatggcggagaatatcgctgccgcccttggaataccggcagaccgtgtcagcgtaaaggcaacgaccgaggaaggtctgggctttacgggcagcggggaaggaatttcagcacaggcaattaccttattgacgacagtgggggattactgttatgatgataaaatcatggacagcggctgtcagggctgtagtggtggctgctgcgggaaataatcaaacaggagggaactatgaaaatttttaatacattgacgaggcagaaggaagaatttgtgccgctggaaccgggaaaggtcaagatgtatgtctgcgggccaacggtatacaacttcattcatataggaaatgcgaggccgatgatcgtgtttgatacggtcagacggtattttgaatacaagggctacgaggtgaattttgtttccaactttaccgatgtggacgataagatcattaagaaggccattgaagagggcgtggatgccgataccatttccaagcgttatatcgaagaatgcaagaaggacatggaagggctgaacgtgaagccggccacgaagaatccgctcgctacagaggaaatctgcgggatgctggatatgatcggcagtctgatcgagagcggccatgcttacgtggcggccgacggaaccgtttatttccgtacaaaatcatttgacggctatggaaagctgtcccataagaatatcgaggatctgcagtccggcttccgtgagatcaaggtgacgggagaggaaggcaaagaggatccgacggatttcgttctctggaagcccaaaaaagaaggggaaccttactgggagtctccatggtgcgagggacgtcctggctggcatatcgagtgttccgtcatgtccaagaagtatttgggcgatcagatcgatatccatgcaggcggagaggaccttgtcttcccgcatcatgagaatgagattgctcagagtgagtcggctaacggcaaagagtttgcaaaatactggatgcacaatgcatttttaaatattgataacaggaagatgtcgaaatccctgggcaatttcttcactgtcagggagatcagcgagaagtatgatttatcgatacttcgtttctttatgctgagcgctcactacagaagcccgctgaatttcagcgcggagctgatggagtcttccaagaatggtttagagcgaattctgactgcggtccaaaagcttaaggatctggagagcagcgcggcaggcgattcgtttaaagaaggcgagagccgggaagctgttgacgagctggttgcaaagtatgaggcagccatggatgacgattttaacaccgcagatggtatttctgctgtctttgaactcgtcaagctgagcaattccacagcagggccagacagttcctgggcttacgtagtatatttgaaagagaccatcgaaaagctgtgcggcgtgctgggcatcgtcaccgagaaaaaggaagagatactggattctgagatcgaagagatgatcgcggcgagacagcaggcgagaaaggataagaatttcgcgctggccgatgagattcgcggaaagcttcttttaaagggaatcgttctggaagacaccagagaaggtgtaaaatggaagagggcgtaagagaagaggtcggattccagaccttttgtaatgaggcgctgaggctgaaggagatggatccgaggacgtattctccgctggcgctggcctatatcggagatgccgtctatgaactgattgtccgcaccatggtgatcaatcatggaagcattcaggtgaacaagatgcataagaagagtgcgtcgctggtcaatgcaggcactcaggcagagatgatacggctcattttggaagagcttacagaagaagagacggcggtctacaaacgcggacgaaacgccaagtcggtgacgacggcgaaacatgcgaccgtggtggactacagaacggcgactggctttgaggcgctttgcggctacctctacctgacgggccgtctggagcggctggtcacactgatcagccacggatttgagaaaataggagaactggaatgacggaagaatttacaatagaaggaagaaacgccgtgctggaggcataccgcgcgggaaagaccatcgataagctttatgtgcaggatggcgtaaaggacggtcctatccagtccattatcagagaggcgaagaagcaggatacgatcgtgaatttcgtttccagggaacgtttgaatcagatgtcggaggaaggccatcaccagggagtgatcgcacatgctgcggcttatgaatatgctgaagtagaggatattttgaaggcggctgaggaaaaaggggaaccaccgtttattttcctgctggatggaattgaggatccccataatctgggcgcgatcatccgtacggctaacttagcgggagcccatggagtgattattccaaaacggcgcgcttccggccttacagcggtagtggcaaagacctcggcgggagccctcaactatacaccggtggcgaaggtgacaaacctggcagccacgattgaagaattgaaggaaaagggactttggttcgtctgtgcggatatgaacggcgaactgatgtaccggctgaatttaaaagggcctgtcggtctggtgatcggcggcgaaggagacggcgtgggaagactcgtcagggaaaaatgtgacatggttgcatcgatccctatgaagggcaatatcgactcactgaacgcttccgtggccgcgggtgtgctcgcttacgagatcgtcagacagcgtctgggctagtgccgcccggcaccagggcctgtttcgatgtgagatggagatgaggaaagatgaagaagaatagaattgtggttctgaccgcctgcacggcgcttatggtgtcggtgagcggctgccagagccagaaggcatctgtggctgaatcgcagacgattgccgcagagagtacagctgcgatggctgaagaaccggagagcctggctgtcgtgactgtcgaagaggaagcggttccgctgtattcaaagccggcggggagcaacgtgagaacgccgcaggcttccggtacgacgacttacagcaataactctgtgacactggatgcgtccaatctgtcccagggctatgtgatggtgcagtatacgggaggctcctccaagatcaaggttcaggtgatcaaaagcggcggagagacgtatacgtatgatttaaatgccagatctgcctatgaggtgttcccgatgtcggaaggcaacggcagctatacggtgagagtgctggaacaggtacagggcaaccagtatgcggtgaagttcagccaggatctgtccgtatctcttgcagaccagtttgcaccgttcttatatccaaatcagtatgtgaatttcactgcggacagcagcgtagtaaagaagggcgcagaggtggccgcgtcttctgcggatgcgctggatgttgtctcgtccgtttacaattatgtggtcaccaacattacatatgatacggcaaaagccaactccgttcagtccggatatcttccgaactgcgattctatcctgtctcagaaaaagggaatttgttttgattacgccgcggttatgacggcgatgctgcgttcccagaatattccgaccaagctggtggtgggatatacgggcagtctgtatcacgcatggattaatgtttatatcgagggccagggctgggtggacaatatcatctactttgacggccaagactggaaactgatggacccgacattcgcctcctccggcaagggagatccggcgattgaagagtatatcaagaacagctcgaattataaagcaaaatactcttattaaaatttcatattataaaggagaagcgatacatggcgaaggaattgaaaaaacattattccgcccgggagctttcggctttctgtcttcagatatctcttctgcttcgcgcggcaatccctcttgatgagggattgtctgttatggcggaggatgcggcagatgaagaggagaaaaagattctgttacatatgtctgaggaagtggagctgggaagcccgttttctgtcgttctggagcaggtgggaagttatccgtcttacgtgatccggatggcgaagctgggcgaggaaacaggaaccctggatcagatgatggcgtctctttcagagtactatgaaaaagaatacattctgatgaaaagcatcaaaaacgcggtgacgtatccggtcatcatgatttttatgcttttggttgtcctgttcgtcctgtttacgaaggtaatgcctatttttgaaagtgtttatgagcagctgggagcacgtctcagccctgtatccatggcggcgacgagactggggggcatattcagcggagtggctcttattgcaggggttcttctggccgcggcggctttcgttatctggctcatgggaagaggcggcaaaaagatacaggcggctcagcgcatgatggaccggtttaagagaaagagccggatcgcgctggcggtggcgaaccgcagatttacttccgtactggctctgacgcttcacagcggtctggagctggaaaagggcatggagctggcagccgagctggtggaaaatcctgcggtagaggaaaagatcaaggcctgcggagaggaactggagacaggaaccgattattacagcgccatgaagaacaccggtctgttcggcggattccatgttcagatgatcaaggtgggcgtcagaagcggccgcctcgatgaggtgatggaggagatatccagaagctgcgaagaggaagcggatacggcgctggacaacatggtgaaccggcttgaaccgacgatggtagccgttctcgcagtggctgtcggtctgattctcctctctgtcatgctgccgttagtcggtgtgctttcagccattggataagaggtgagccgatgaaaagatggaaacagacagggaaggaaatctatggctacgtcctgtccgtactggtatttctgtgcgtactggcgctttttgtaacaggaatcatgtccttttcaaagaaggccgatgcgagaggtgcggatacgctgcgggatgccatacggagagcttccgtgcagtgctacgccattgaaggcagatatccgcccagtgtggattatctggaggaaaattacggaattttgattgaccgggataagtatgatgtgttttacagcggattcgcgtccaacttcatgccggatattacggtcaatcttcacgaataatagctgggaggtgcgcggatgggccgcagaaatgatcataagggacagctggtgaatacgttgtttaccatgcttctgttcctcgtatttgtgctctgtgcgctgtttgcggttttgatcggaggaaaggtctacgagaatatcaatgccaggacggagtcgacctaccgcggcgatgtggctctgagctatattgccaacaaggtaaggcagggcgatgaggacggaatggtgggactgaccgagatggatggaatcacagtccttcagttgaagcaggagataaacggttctgaatacgtgacttatatctactatagggatggaaagctttgggagctgttcaccgatacggagagcggtctgggcgtaaatgacggctatgagattctggagtgcgacgaagtggccatgtccatggacggggaactgctttccgtctcaaccagtggcgatggaggcggccggatctggctgtctttaagaagcggaggatgaaaggatgagcaggaaacagcattcgggtatatttatgatggagatgatcatagtggtcttcttcttcattctctgctccagcgtctgcatcctggtcttcgtgaaaggggaccggatgagccgggacgccgcagatttgaaccagtcggtactgattgcccagagcgtggccgaggtatggaagctggagggaccggaggggctgaaacagcgtttcggcgccagtgtctctacacaggacgacgcctctggagcagacggcgatgatgcctttaaaacagatggtgatgaagccgccgggaaccggtacgtgatggaatttgataaaaatggaaaccttgcggaagatactccggagggcggcggagacggaagcgcgagtggaaagatctacacagcagtgctttcggcggacgaagcggagagctcggcggagataaccgtcagccgtgagaaaaacagcgtctacacgctctctgtaagccgccacgagagagagcaggggtgacaggaggaaacagatggctaagcaggagagcggatttaaggcgaatattggaagttcttctctgatactgatttttatcgttatgtgtctcgtcacgttcggtatgctgtccctgacctccgcaaagagtgatttaagccttgcaaacagaaacgcggacgcagttacggagtattacagggctgatacggaaggcgaggcattctaccgcatggtggcgggggaagtgaagacggcctgtgccaatgcctcagggcatgaggagcgccttgcgctgcttgagaaagcgctgggagaatattacagagacggcgcggcggtgacggaagtggccatggaacgcgcgcaggcacttcatattgagctggaaccggatttggagggggaaggctcggtgcgtgtgacgaaatggaacgtgattcagacggaagattacgaaatagatgactccatgccggtatggggcggaacggttgatacagaacagaaatagtccgtttgcggattccggcgggaaagaaagacagggagatttgcaggtatgaaggtaattgatttgttgagttcggctgtggaacagaatgcgtcggatatttttctggtacccggcatgccgttctcttataagctgggcagcagaattgtctgccagaatgaggagaagctgtttccggctcagatggagacgctgatcacagaactttatgaactggcggggaaccgcagtatggagaaggtgagagagcatggagacgacgatttctccttcgcccttcccggtgtgtcaagattccgctccagtgtgttccggcagaggggatcgttagccgccgttatccgggtggttacgttcgatctgcccgattatgagacgcttcacataccacagaatatcatcgatatcgcccagctgaccaagggcttcgtcctggtcacgggaccggccggcagcggtaagagcacgacgctggcgtgtatcattgacaagatcaatcatacgagaaacgcccacgtcattacgctggaggacccgatcgagtatctgcaccgtcataagaagagcgtggtaacccagagagagatcgtgacggacacggacagctatgtctccggactccgggcagcccttcgtcaggcgccggatgtcattctggtaggtgagatgcgtgattatgagacgatccagatcgccatgacggcggcggagacgggccatctcgtcatctctacgcttcatacggtcggggcggccaataccatagaccgtatcatcgataatttcccgccgaatcagcagcagcagatccggatgcagatctccatggtcatgcaggcggttgtgtcccagcagctgattcctacggtggatggcggcgtttatccggcctttgagattatgtttttcaacaatgcaatccggaacatgatccgcgagtccaagacgcaccagatcgacagcgtgatcgccacaggacagtcggaaggaatggtatccatggacaccagccttttaaacctctataagaaggggatgattacaaaagaaagcgccgtgatctacagcagcaatggtgagctgatggcgaaaaaaatcgaacgtcagggttaaggataaagcatatttttcccataaccagttatactatccgtaagacaagacaggagagtgaactgattatgagaacggataagagaaaagtggcgctcatcggcaccggtatggtgggtatgagctatgcatattccatgctgaatcagaatatctgtaatgaactggttctgattgacatcaacagaaaaagggcagaaggcgaggcgatggatttaaaccatggacttgccttttctgcgtccaatatgaagatttacgccggggaatataaggatacgtcagacgcggatatcgccgtcatctgcgccggtgtggcacagaagccgggggagagcaggctaaacctgttaaaacgaaacgcagcggtatttaaatcgattgtagacccgattacggagtcgggattcaacggaatattcttggtggcgacaaatccggtggatatcatgacccggatcacgtactcgctttccggcttcaatccgcggagagtgctgggcagcggaaccgccctggataccgccagactgcgttaccttttgggagaatccctttccgtggatccgcgtaatgtccatgcctatgtgatgggagagcacggagacagcgaatttgttccgtggagtcaggcgatgatcgccacgaagcccatcctttccctttgtggtgaacagggggatggcgggatggaggtcatctgcggggaagaattaaaacggattgaggaggacgtgcgcggggctgcataccagattattgaggcgaagagcgccacgtactatggaattggtatggcgctgtccaggatcacgagagcgattctgggagatgaaaacagtgtgctgaccgtatccgccatgctgcgcggagagtatgggcagaacgacgtatatgccggcgttccctgtattatcaacaagaacggcattttccgcgtgcttccgctggatttgaacgaagaggaaaagaagcgtctgggcgagtcctgtgacacgctccgggccagcttcgatgaactggaaaaataatagacaaaggtaaaacggaaaaagaaatagaaggaccagccgtccgtttgagcggctagtcctttttcttttcttccgcggcctcggatgctttggtctcttcggcgtttaaatcttcctcatcactcacatactccagaattgcactgatatcacagtccagatattcgcagactcttgccatcagggccaggtcgacgcgggagaccttgttgttgcagtaattgttcagctgagtccgctggacttcacagtgataacagactttgtttttgcttttgcctttttcgaagattaaatcagccagcttgatattaatatgccccataaaatgcctccttccgtatagtgatattatatgtaaatatatctaagaagataagatgtatttaaatagatatattttagtagatatatttatacagatgtattaaaatacaggtataagaagatacacaaaagaaaggaagaaccgaatgaagagatgttcctgctttgcagtcgcggttattctgatggtgacactatacagaatgataccacattatgagatattagcacagtacagtttcagctctcccggcagcagggagacgacgattctggcagtcagccacaccgtcgggccagcactttacatatcaggagaaaatatcttaagactgcacaggaaactgaattacgatgttccttccaaccgggtgattctgatgctttacggaaagaaaagcgatgtggagaaggggaaatgcagcgtaatcatgatttatgagggtgaggacggcagcagggaagaagatgccggtattgtgttaataaaatgatcgcagataaagaaaggaagagtgccggaaatggtctgtttccggcactctgcgtttgaaatggagacgttatggaacaattctgcatccggtgagctttaagtactgcccgtcgctcacggtgatatatttcgaaccttcaaaattatcatttgagataatcgagtcgagcacgtggtaactgtccttggatatctcgacatagccaaatccgataacggaatcctcatctacctcaattttatactctcctgccggaatgtgtacgccgaccttaaacataccgtcgctgctggtatccggactgcctgcctcttcgatcggaacggcatagcacccggtcatcttaaaatactgtccatcggagatggtaacgatggaattggtggaaatattatcgttggcaatgatggagtcaagggttccgctgctgtcctttgcggtctctatgtatcccatgaaggagtcgcagtacacgacgtattcccctgcgggaatgtcgcttcctactttgtaggtgctggctttatacctggttttcgccggttcggaggtttcttcgttctctgcagggcctgtgttcttttcttctgtaccggctggttcactcatggttgtttccgcggccggcggtacgggggttgaagtctgtgaaccggcattagagagtccgaaaataaaaacgattacatagaaaagagtaataatgactctggccggtttattgaattttttgtatttccacatcagaaagaggccgattggaaaacagcagaacagcagcatcagcacaataaaccagatcttggaataaaatggttcttttaccggcacggagacgggggaattgtccaccggtactccgttaatacttgtctggtgagccggcgtttccggtattgtttccgtcggttccccacagcttggacagaatttcccatcaaattctgtcccacattttcgacaaaacattttcatttcctccctacattttaaattttttgccgcagtttaagcaggtgacctgaacttttttggcgcccagattaccggctaccaaacccagcggacctacaagcgcagcgcccacaaccgcttttccgataccgaagcccttcttattgcctgacagcgaagtggagccgcatctggggcatttcgccatggaatcgtattgctgctgctggatttttaactgttcctgctgcgcctgcagggccatggcctgcatctttacctgagcctgctgcagctgtaagtcattctgggtctttacctgttccagagcggtttcggacagcggtgcgcggcagttggtacagaagttggcgccgctggaattgacggagccgcagcccggacaaacaacggaatccgcaggcagcacctgctcctccgctggttcgagacgttttccacaggcagaacagaaggcgctgtcgtcggagatagcggcattacaatgtggacaaatcataaaaaatccccccttttgtttttttttattaaaacgccagtggctgttttaattcttgtgtacgcaatgtacagaatatttatttataataactatacaacgtttttggtgtgatacggctggaatatactgggaaaagggggaggacagtgatgcaggtacatgatggcccatgatcagctgcggtggctgcgctgtgcataaatccatcgattcacactattcttacttgtcccatataatattgtgtagtgcaatattaaaggagataaatgattatgagttgtgaaacttttaaatgcagatgtagatgcagatgttatgaaaaatgtgagcctaagcgtgaatgcggatgcagacatgaatgtgaggcaaaacgggaatgtgaatgcagacgggaatgcgaaccaaaacgcgagtgcgaatgcagacgggaatgcgaaccaaaacgtgagtgcgagtgcaagcccagatatgagtgcaaaccggagtgtgaatatgagcccaggcgtgaatatgaatgtgaatgcgaacatgaacacgagcaggatcagggcaaaaactgtgaatggttcgaaaaagtattaagagaattttactggagcggcttccatgatggctgtaagaaatgtggacgtaaagaaaatgaatgtggctatgaagggtacgaagagtataaaaaataggttttgaaaagagcaggttttgatattcgggactgttttaaaagatttagtcattttcttgtgatggatttaaggaatgctttaagggatattttaagaaatgcgtaaagaagagaataatagaaacatatggataaaaatgatagaggcggtctgtacaggccgccttataattttgaaaaagtatgatctgtttgttttaaacctgtacgatctgtttcggatattatttctcttacagcgaatagctaattcagcagtggatagcgcgtatgcaagagccggtatgcatttcgtgaatggtatgctgcaatgcagaatgaatctctctcggaaattttagtgtgtaatggggagaacgatgaatggcgagagagatggagcgcatgatattgtatcgggttactgtggtattacaggcgatggtctttacggatctccctgcttttattataccttatcttgtattatattattttatccatcattacttagcttgttttattttattgtgcggccggtcacattctctttaagtgaaagcttcgtaatagtatatccctcaaggctggccaggcggcacagcatttctataaggcttaataccttttgttctctcttcacatcatcatcatcatcgttaatcttatgcatataaaatcctccttaaagtacgccccaccctaagctaactatataatagggcggagctgttggagaaaaaaagggcagtctcaatttgctgcctgccaaaagaaacgcttatttactttacttaaaaaggggagtgcagtgccatttccggaagatggaaagaaaagataaatagaaaaaaacccttgaataatcaagggttttaaccagctgatgacgggactcggacccgtgacctcctcactaccaatgaggtgcgctaccacctgtgccacatcagcgttttgtgttatagctcgtcaagcgaacctcatatatagtagcatgagaaattatatttgtcaacaggaaaattataaaattttttatccaaatcgagaatctttgacggaagcttttttccgtggtatactgttcccacgtggcgacaggaggtatttcatgaagaagaaacgcagaaaaagaaaaagtgcatgggccgttttttttaggcccatgaaagtgatattctcaatttttttaattctgatgattctggggctgggagccggcggtatcgtatatctgaagttcggggatgagatttcggcctgtaaggaacgggcggatcagattgtggcacaatcgaagagagaagatttttcgcagccatcggataccaggatctacgattcatcgggacaggtgatcggaattatcaacacaggacattatgagtatgtaccgattacagaaatcagcgagaatctgcagaatgcgtatattgcccaggaggacaagcgtttttataagcatcacggtgtggattttatcggccttgcgagggcgggtgtggctctggttaagaataagggagagattacccagggcggcagcaccattacgcagcaggtcattaagaatacgtatttaacgcaggaaaaatcatttataagaaagattacggagatatttgcggcacctcagatggaggaaaagtattctaaagccgatatcctggagttttactgcaatactaatttctatgcaaaccgctgttacggagtggccaaggccagcctctattattttaacaaagaggcaaaggatttaaccgtctgggaagcggccacccttgcaggaatcagcaacaatccgtcacgctataatccagtggcccacccggaggcagccctggaaaagagaaataaaatcattgacaacatgcagaaaaacggtatgctcacggaggcagagtgcgaggaagcgaaggcacagccgcttacggtagccaaggtaaccgaggaagggacgaaggagacttaccagtccagctatgcggtccactgtgcggctcaggagctgatgaagaacgacggcttcgagttcgaatacacctttgccgatgagaccgcttacaacgattataaggagcgctatcaggaagcataccaggagaagagcgatttgatccgcaacggcgggtttgagattcatacaagccttgacagtacgcttcagacgcagcttcaggcaggtatcgatgagacgctggcgaagttcaccgacgtctcggacaatgggaaatacgcgcttcagggagccgctgtctgcatcgacaaccggactggctacgtggtggcgatttccggcggacggggaaccgatgatgagtacaacagaggatttttaagcagacgtcagcccggctcgacgattaagccgctgattgactatgcgcctgcttttgaaaccggttattactacccgtcgagaatcgtaaacgaccacttatttgacaaggggccgaagaacagcgggaataaatattacggagaagtctccgtgagggaggctcttaaccggagcttaaacacggtcgcctggcaggtgctggcggatatcggtgtggattacggaacgagctatctcgataagatgcattttgtgggactcagctatctggataactggaataccagcatgagtatcggcggctttaccgaaggcgcccgtgtcgtggacatggcaagggggtactccgttctggccaatggcggcatgtacagcaacaatacgtgtatcaccggcattgacagtcagtacgaaggcgacctctatcaggaaaaccagccggaggaacgtattttcactgaggatacggcgtatatggtcactgatgtcttaaaaggtactttaaaccagccatacggtaccggatacggtctgggactctcgataccggcagcagggaagacgggaacgaccaacagcagtaaggacacctggttctgcggctataccaagtactataccaccgctgtctgggtcggttacgatacaccgaaagccatgccgggagtatatggcaagacgtatgccggtaagatctggtatgattttatgaagcagtgcaatgagggccttccggctgaggactgggtcatgccgtcaacggtggcctactacaatgtggactccagaggcgagaaaaccagcctggagaccgggaaacaggatttgttttcttccgtggcagagcagaatgcgaggtccaactccaaaaagtgggatgaggaacagaagatgaaggaagaaaacgccagggctgccgccgagcaggcatccagagacgctgcggcacagggccaggaacaggcagccgcagggcttacggctctgatcggtgaattaaatggcctgacttaccgggatgaggcgacgcaggagatgatcatccagggacagtcgatgctggatctgctggccggcatggagcagtatgatgctttgaagcagcagttcgatgaggcggcagacagggcagaagcgcttccgtatgaggaacagagcataccgccgtcccaggagattgggccggggatcacccatgaggcgagacctggcgaggccccctccagcacggaggacgtcacctccggccaggcccctgtagtgcagccgggtgcggcaccgggcggtttcgaagcagtcgggccgggcggtcagtaaggaaaacaatcgctacgttaaaaaggaattgtgaataacttttcttttttagcgtagtttttgctttcttcaatcacaaaccagttttctctgtaaacagatggaacaactggggagcagagcgctgcggacagaatattgtcatgatgacgtactggacaggacaagggaacagtactatcacatatataaacccggtaactagtactgcattgcgcaatgcagtactagtgccgccggacctaaatacatactgcatagcgcccgctatctacgccaggcgcacgcccgcgaagctagtcgtagggtccactacgccgtcgcttcgcggacgcacacctgacgcagatatcatgcactatgcagtacgcatttaagtccggtgacactagtctctccgccacaggagaaaaaagcgcttgcctggataaatgatcctgtgttatactgctgtcataaacggatgacagcctttataagaagctatcgccaccggaatccggtttctttccgtattcctttctgccaatttcatcaggcattctctgtccggtcggacttaagaattcccattttacaaaaaaacacatgtaagtaatactgaaaaaataagcagggctattgtctgttttacgaataaacattataatggagataggttcttatatagctggaaacggaggctatatgagcaatgagaacgatgcataccgcataacggagataccagccaatttcccggcggaagacctggtattaaagagtgccatgcagtttttcaaggatgaattactgtcatacctgggaattacggaggaaccggtaaccatggggccgacagagtttgtccacctggaggcaaagcagttatatgaagattttaacttcatcaagcctgaccggagctggattcatctggagtttgagagcgatggaatcagggaggaggatctgcggcgcttccgcagctatgaagcggtcacttcatttatccgtcgtgctgatatcacgacgtatgtgatctgctcatcgacggtaaaggagattcgattcgagttaaacacagggtataatacataccggatcataccggtccggttaaaggacagagactcagatgaactgtttgccgggctgttcaaaaagcagaagcagggagtaaaaccgaatcgggcagatcttgtcccgttgctgctcgccactctgatgtccgggaacacagatcagaaagagcggattatactggcgaaccgcctgatcacagaatccggcacgctatcagagtcagacatggtaaggatgcaggcagtcctttatacccttgccaacaagtttctgtcaaaagacgatttaaatcaggtaaaggaggcgctgttcatgacaccattgggtcaaatgctggtaaacgatggaattgaaaagggaatggaaatgggtatggaaaaaggaattaaaaaagggatcgaaaaaggcgcgagcgctctgatttccgcatgccaggaagtaggacttacctatgatagcacccgtaaaaaactgatcgagaagctggaattggatgcttcaactgcatccagatatatggaagaattctggtccgtgctctccaagcagtagggtatattttggggttgctttttattcgaatagctgttatgctagatgaggatttaacaaaacaagcgagaattcccccgcctctataagtggagggatgaaacgccaagaacaagcttaacggcagtggcggatggagagaaatcggtatcccccactggcatgaagtcaagccgcgcatctataagaagtagtcatactctgtgaaattattgagcgtggattgaaacaagaaattaaaataaatgatgaagggaagtgaaccagagtggaaggtcgaagtcagaagatggaagcagacaattatcataagcgagtggtagtgtgggcagagtcgatgacttcggaactgctctgtcttcactgccgttaaagaatagtcttttgcgcttatgatagccatttcctgggggtcggtccctcagggatggctatttttgcgtgctgcttccacggtaaaccacacttgaaaaataaggttcgtatggaaggagaagaaaaatgcaggagaattttaacatggaagaactgatggacctgctgtttacccgtcagttccgtaaattgaaagacatattgacagagatgaacgaggtggatatcgccacctttatcgaggaactggattcagagaagacggtggtagtcttccggatgctgcccaaggagctggcctcggacgtatttgcgtgcctggaggtggataagcaggagcatattatcaacagcatcacggactatgaactggggaccattgtggatgatctgttcgtggacgatgcggttgatatgctggaggagcttccggccaatgtggtaaaacgtgtgcttaaaaatgccaggcccgacacgagaaaactgatcaaccagtttttaaactatccggaaaacagcgccggcagcatcatgacggcagagtatgtagggcttaagcagtccatgaccgtggagcaggcgtttgcctatatccggaaaaacggggtggataaagagactatttacacctgctatgtcatggatgcgaaacggagactggaaggggttgtcacggtaaaggacttactgatgaatccctacgaggaaataatcggaaatatcatggatacccatgttattaaggcttttaccaccgaagatcaggagaaagtggcggacagcttccagaaatacgaccttttgagccttccggtggtagatcatgaagaacgcctcgtcggtattgtgacggtggatgacgtggtggatgtcatggaacaggaggcaaccgaggacttcgaaaagatggcggccatgcttcccagtgaaaagccgtatttaaagacaggagtcttccagctggccaaaaacaggattgcctggctgttgattctgatgatcagcagcatgataaccggcggaatcctggcaaagtacgaggccgctttcgcggtgatcccgcttctggtaacctttattcccatgctgaccgacaccggcggcaacgcaggaagccagagcagcaccatgattatccgtggtatggcggtaggtgagattgagccgggcgacttatttaaagtgctctggaaagagcttcgggtgggaattatcgtcggagccattctgggcttcgtcaattacgttcgcctcgtaattctttatccgggcaaagaaatgctgtgcctgaccgttgtactgagcctgatggtaaccgtcgttattgccaagaccatcggatgcgtgctcccgattgcggcaaaagtgttccatatggatccggccatcatggcggctccgctgattacgacgattgtggatgcggtgagtttgattatttatttccagctggcgtgttcgctgctgggcttataggacatggggctgggccctggagaacagcagtccggatcgcttctgtgaaattcggataccagtagagaaaaagtagtgttttgcaggatacgaaaagggagtattatttatgattgagtataagaaaatcagtgattttccaaaaggaacattatacagccaactaagcagtgcatattctttccatgatagttttaaaaaatattgggaagaaatgtggaaagagtatgactgctttttttattctaatttagatattgcagacaaatgcggattcataactgtcttgaatgggaaagcaatcggtcacatttcatgggatccgaggaacaatccggactatgtgatcataggccataactgcattttaagtgaacataaaggctgcggttatgggaaagagcaattgcgggaagcaattgcaagaattaaaaagagcgggacccaaaaagctgttgtaacaacgaatggtatactaatacccgctcaaaaaaattatgaaagtgtgggatttaagaaaattttagtaagagaaaataaagatacaccatttgcaggtgactatatagactatgaactgatattctaatcagaatagccgtttctagagcaaatcccgttctatttatctcatgttttttacttatggagccagtacccggccccagtgatggaggaggggccgcccttttttcctgccttccggctttagttcctgccgccgaggaaacaagagcctgcagccccttctccatctccctccgcctctcctccatcactggggcgtccctcccttatttccatgtattccctttacatcccccgcatgatatgatacactttacctatcgtactgtttttttataaataacgctcgagagaggaggaaatcaatgactacaggagcagttatacttgctgcggggcacaaaagctcgactaccagtttccagcccatgcttccggtcggagacacgactgcggtgaagcggattatcattacgcttcagagagctggtgtggagccggtggtggtgattacgggagacagaggagaggagctggagaagcatatttccaagatgcgcgtggtatgcttaaggaatgcggagtatgcgacgactcagctgttcgacagtatctgcatgggattaaactacatcgaggatctgtgtgaccgggtgctggtcatgccgacaaaggttccgctgctgctgtcggagaccatcgaaaagattatggaaagtgaggcgcctctgtgctgtcccgtatatgagggcagaagaggccatccggtgatgatagcggcggactggatcccgaagatcctgaactaccagggagagtacgggctgcgcagttttctgcgggagccggaagcggatgcggtgctggaggagattccggtggatgacagagggattattcaggccgtggagacggacgaagactgtgccatggccatgagcggaaatcatggcaagctgccgcttcacagccgtatgtcactctacctggaatgcgacgaagtcttttttggaccgggaatcgcccagtttctgtcgctgatcgaccataccgggtccatgcagacggcgtgcaaacagatgcacatgtcctacagtaagggatggaagatcatgaagaccgcggagcgggagcttggctatccgctattaatcacccagtcgggcggagcggagggcggcttttcacagctgactccgaagacgaaggactttttaaaccgttttttgcagatggagcaggagatgaacagccatgcttcacgattgtttgaaaaatattttggagatgagaggtaatggggatgaaacagttattcgaagagatgaagcagattctggagcagggagacgacctggtgctggtgacggtgatcgccggttccggttccacaccgaggggcgcgggagccaggatgatcgtcagaaaagacgggacaaccatgggaaccattggcggcggcgcggtagaatatcaggcaggacgcatggctctcgatgtgctggagagtaaaagctccttcagcaagggctttaaactggtaaaaggccaggtggcggatctgggaatgatctgcggcggagacgtagtggtctatttccagtatgtaagcccggacaaccaggcatttcttgccatctgtgaggaaggcatccaggcatgtgagcgggatgaggacagctggatcatcactgatattacagacgagacggcctgggccgtggggatctattcggaaagccgcggatttgccggaatcaccgtggagggcgatatagaaccgctgacacaggcaaaggcggtgcagacctccgtaagcggcagaaagtattacagcgagccgcttcagagagctggtacggtatacgtgttcggcggcggccatgtggcgcaggagctggttccggtgattgcccatgtgggattcaaatgcgtggtttatgatgaccgccctgaatttgccaacagcagactgtttccggatgcggtgaataccatagtcggtgattttaccagtgtctttgataaggtgacaattcgtgagcaggattacgttgtgatcatgacgagaggccatcagtgtgactacgacgttcagaaacaggttcttaagacgccggcccactatatcggagtgatgggaagccgccagaagctgatgacgcttgccggaaaactgaaggcagagggcttcaccgaccaggatatcgagcggttctacagcccgatcggactggcgattctggcggagactcccgcggaaatcgccatcagcgtggcgggcgaactgattatggtcagagccaggagagagggccggacgaaatgacagagcgccatctctttttaaagggacggtccggggccgggaagacgacgtgtctcctgtcctgcctggagccttactggaagggcgcggggggatttttgacccagcgcctgacagacggagacggtgagactgcgggatttcgcttcctgccggtggagaacatggaagaaataccttccgtgacgagggcctatgagcctggcctagagggcattttcattgagcgaacaccggagggatggagaaaatatccggaagtgtttgagacgctgggagcggagatactgaaccgcctgctggaacatccggaacggtaccgtttctgctatatcgatgagatcggcggcgtggaactgaaggtaaagccattcatggagcggctggaacggctgctcgggagtcaggccttctgtgtcggagtgctgaagcattcgggaaatctggcctctatgggtacgagaattccgcttcctgccaatgcagccccggacagggagtggctggaggcacagatggagcagcgcttcgactgccggattctggcctttgacggaggcgaagcggagaaaatggaaatcaggcggatcatagacctgcggctttccggaacaacagagaaagggagtgaaaagtgatggcagataaacatcgggtgcgagtgcggctcaccgcaatggtggttctgtttgcagtctgctttttcggttccttcatgctggggagatatccgattgaaccgtggacgctgattcgggtgctggcgtcgagagtcattccggttacaccggactggccttcgcaggtagagacggttcttttcaacgtccgccttccccgggtattaatggcggcgctgatcggagcaggactggcggcggcgggagcagcctatcagggaatatttaagaatcccatggtctcgccggatgtgctgggagcgtcgtcaggcgccggctttggagccgccctggggctgttcctctcattctcctaccagggagtatcgtttctggcgtttgttctgggactgtcggctgtgggggctgtctgcctgatcagcagccgcgtgaaatacaaccagacgctgggcctggtgctggccggaatgatgatcagctccctgtttacggcggctgtgtcatttttaaagcttgtggcggaccccaacaatacgctgccggtgatcacatactggctcatgggaagcctggcctcgatccggcctaaggatttagcctttgcggcgccgtggatcatcggcgggatcatccccatttacctgctgcgctggaagatcaatgtgctgacactgggtgaggaagaagcgcgctgtatcggtgtcaacaccagtgcggtccggcttgccgtggtgctctgtgcgacgcttatcacatcggcggccgtgtcggtcagcggtctgatcggctgggtggggctggtaatacctcactttgcccggatgctggtgggaagcgactacaggaagatgcttccagcctctttgcttttgggcgcaagctttttgctggtggtcgataacttcgccaggcttctggcgaccagcgagatacccatcggaattctcaccgcatttgtgggagcgccgtttttcctctggctgatcctgagggaaggaaataaactttgagaggtggtagaatatggggctgatcgtagaaaatctgaccttcggctaccggtgctttcccgtcctgaagggcgtggatttttccgtggaaacgggaaatctcgtctgtatgctgggaaaaaacggtgccggtaagagcacgctgttccggtgtattctgggcctcttaaaggggtaccacgggaaaatcatggccgatggggtggacctccgaacgctgaaagagaaagagctggccagaaagattgcctatatcccccagaatcacgatcaggcgtttgccttttcggttctggacatggtgatgatgggaaccacatcgtcgcttcagggattaaagagccctggcagggaacagagggaggcggcatttgatgcgcttaagaccatgaggatcgaggcaatggcggagcgctcttacgctcatttaagcggaggggaacagcagctggtgctgatagccagggcgatcgcacagcaggcgggaatcctcattatggatgagccgtgtgcaaatctggactacggcaatcaggccagagtcatggaggagttaaagcggcttgccggggagggatatttaatcgtacagtctacccacagcccggatcaggcgtttctctatgccgatcaggctgcggtgctttcagacggggtgataaaggcatttggaaagccggaggaggtgctgacagaatcgcttctggagaccatgtacggcataccggttcgtttgtttgacgcgggagacacggggagaaagctgtgcatgcccgatcgggtgaagggggaataaatgatgtgggaactgtatgaaaggctgatagagccgataccggacgatgttccggtggatgaaataatagtgggaacaagctgtaccatggtgagagccggaggagcagcgggggcggccgccaaccagaggctggagagccggccgcgcatcctggaggaagaggagtgggaacggggcatgacctggagacaggcggcgtccctgatttcctcctggaactttctggaggccggaatcggagcggcggccattaacgcctattataaccgggaggccgtgctgatggacggaatcgctgcgtatgagggcgtaaaaatcctggaaagctgcgatacgtttgcggcgccgggagacgcgtttgcgggaaaaaaagtggcgactatcggccatttccattatgcggagcgctatctggaaaaggcaggagaactctttgttctggagagggaaccgcgggagggcgactatccggatacggcctgcgaatacattttgccggaaatggattacatctacataacagggttcactctggtgaataagacgcttccaagacttttggaactgtccggcaatgccagggtgattctggtgggacccagcgtcccgatggcgccggtgctgtttgaatttggcgtgaaggaactcgccggaacgctgattacggatatggcgaagaccgaacgctacatccgccacggcagccaccgggcagtagtgcgctccggtatacccgtgagagcaggatatcagaattaacaaataagggaggcaatatcatgaagaaaagaaaaaacatatggctgggcctgtcactcgctgcagtcatgatgatgggactcggcggatgtgccaaaggatccggaaatgccggagaggcacagcagactgcggtggagaccactgccgcggcgatagctgacacgacagcggaggcttcacaggagacggataaggcagattctgcggccggagacaaggctgcgcaggcggaaggaacgagaatcatcacggactcagccgggagagaggtggagatcccttcggaaatcacgaagatcgcgccctccggtcccctggcccagatcgtgctctacacggtgagcccggataagctggccggtctggcggctgatttctccgatgaggcgaagcagtatatcgatgaaaagtactggggactgccaaaattcggacagttctacggaaagaacgcaagtcttaacatggaagctctgattgcggaagcgccggatgtcatcattgacataggagaggcgaagaagacggtgaaagaggacatggatgctcttcaggagcagttgaatattccggttatctttgtggaagcgacgctacccaccatggcagacgcctacgagatgctgggagatatcaccggtgagaaggagcaggccgaaaaactggcggattactgccgggcagagatcgggaaggcggatcagaatgcggcggccatcgctgacgcagacagaaagagtgtgtatttcgggcttggtgacgacggccttcacaccaatgccaaaggctccatccacgccgacgtgatcgatcggattggagcggtcaacgcggccgatgtggaagcggtatccagcggaggcggaagcgaagtctccttcgaacaggtactgctgtggaacccggatttgatcatcgtagattcccagaagctctatgatacgcttactgcggatcccatgtggcaggagctggatgccgtgaaaaacggtaaaatcttcaaaattcccactgcaccatacagctttatgagcagcccgccctctgtaaaccgtatgatcggcatcgagtggcttggcagtctcgtatatccggagatctatacatcggatattcgggaagaagtgaagaatttctaccagcttttctatcatatcgatgtgacggacgaaaaactggaggcaatactgaagggggcagttagtgggtaaagatacgcggacttttgcatagggaatagaggaaaagggagagcgggcggcagggagggaaaggttcagggattccgagggggtgggactaagggcgaacagccccctccgcaggagtcccgggcaattcgaccgaacgcctgatgcgttcgctctcagtgcccgcaaaatcgcgtcctgaaaacgcgattttgcccctgctccggcggctgttcaccctaagtcccaccgacctctccatcattcacctttccctccctgccgcccgctctcccttttccggccaggctgtgaaaaaagtccgctgtgtcctggctccataaggggtggaaagacatcattgaaccggccataaaaacaggtggaaagaatctgggattatatcttggtcaataaacgacagttttatcttaaggcggcgtttcgtattattttttgcaggttttgtcggccgcctgtttaaatttttcttttatcgttatacgttatcctcatcttttgcgagaaaccacaggttcttactgatggacagaagtgtcattgtaaacaggattgattccccagtccctgccagagccaaggcatatacatgatctcgcatatcataatgtttccttctgtatgtataaactgtgttggcctctgatgttttgtgaaatttcagggatcaaacgcattgcagtcttatttgcagtcagtgtttaatccggtctgttgccagacagagccgggggcgctgacggcctcttaccgcctgcttttatagccagttccataaaacagagccagctctctctcttcccttgtgtagccagtacccagcggactttttcacagcctggccggaaacggaagcgggggtgacagggagggaatagcgaatgatgcagaggtcggtgggacttagataaacagtccccggagcaggggcgaaatcgcgttttcaggacgcgattttgcgggcactgagagcgaacgcatcaggcgttcggtcgaattgcccgggacccctgcggagggggctgttttcccttagtcccaccccctcggaatccctgagcggttccctccctgtcacctccgcttccgtttccttgataccccacgcaaaagtccgcgtacctcccacacaaaaccactatatccaaaaaaatacgcgaagccggggaatggcttcgcgtattttcttcatttatgcgcagatatttaagccttgtttacaaaagactcgcagtctgtacattccttcatggtcgggttcgcctcatgagttcctaccttgatggtctcaagagtacagtagttctcactctttgcatggtgggtgcagttgttgatggtacactggatacattcgttctttccgtttactaacatagatggatacctccttaatcattttatcggtaatattatctgcagaaatgaagaaaatatacggatgaatgtcagcgcagttttcaaacacgctctgggacttgttagattgtatgtttgggtgtatactattttcattgaaaaaaatttgacagaaaggttttggggaggtcgtaggggtgggacagaaacagaagacaaaacaggtgatcatgacggaaggcgtaatctggaagcagcttttggcgttttccatgccgcttctggtaggcaatctttttcagcagctgtataataccgtggattccatcgtggttggaaacttcatcggcagcgaagcactggctgcggttggttccagcaactccctgatcaatctgatcatcggcatgtttatgggaattgccaccggcgcgggagtgattatctcccagtattacggggcgaaggacgatcagaagcttcactgggcggtgcatacctgcatggcgctgagtctgatcggaggcacgctgctgatcgtgctgggcgtgcttctgtccccgctgatcctgaaatggatgggcacgcccgaagaggttatgcccaattctgtcgcctacctgcgcatcttcttctgcggttccctgttcaatctggtatacaacatgggcgccggagttctgagggcggtgggagactccaggcggcctctctattatctctgtgtatcctctgtggtaaacatcattctggacatggtttttgtggtagtattccatatggggacggccggagtcggttatgccaccgtgatcgcgcaggcggtttcttctgtgcttacggtgcggacgctgatgaaaacggaggacagctaccgtctggttccttccgagatcaggatcgaccggcgcatgatgaagcggatcttaaagctgggcataccgagcggaattcagcagagcatcatatccctgtccaatgttatcgtccaggcgaacatcaatggcttcggagcggccgccatggcgggctacggcgcctacagcaaggtggatggcttcgccatgctgccgcttcagagcttctgcatggcttcgaccaccttcacaggccagaatatcggcgcgaaaaaggcaaaacgtgtcaaggatgggatgtttcagggaattgccatcagcctgatttatacggcctttatctcggtcatcctttatttaaatgcggacaagattctccgcatcttctcaccggatgaggcggttatctccttcgggcatactaccatggccatcctgcttccgttttactggtccattgcgatccacaatatcctgatgggaagtatccggggaagcggaagaaccatgattaccatgttgatcggcgttggaaacatgtgtatcctgcgcatgatatatattaatttactggttccattttttccgagttttgaggctgtcatgtggtgctatccaatcacctggatgacgacgatgctgatggactgcgtctacagcgcaaaggctaaatggattccgaaaggagaatagacgatatgaaacacggatttattcgggtggcagcagcgactccggatgtaaaagtggctgatcctcagtttaacaggacagaaatctgcgctcttatcagggcgggtatagagagaaaggcgaagctcatggtattcccggagctgtcgcttaccgcatatacatgcggagacttattcggtcaggacgcgttgctgtccggtgcgagaagagaactgaaagagattataaaggagacggaaggctccgacttactggcgttcatcggaatgccgtgggagaggggcggaaagctctataatgcagccgtggcggttcagaacggcagaatcctgggcgtggtgccgaagacgaatcttcctaattatgcggaattctacgagcgccgttatttcgagccgggcaatgagattccggtgatggtaagctgggagggacagcgtttccccatggggacgaatatcctgtttgcctgtgaggagatgccgggattgatcgtagccgcggaaatctgcgaggatgcctgggtaccgtgtccgccttcgattcgccatacggcggcaggagcgaccgtgatcgtcaactgttcagccagcgacgagaccacaggaaaggatatctaccgcagaagcctgatcaccggccattccgccagcctcgtctgcggctatgtctatgccaatgcgggagacggcgagtccacccaggacctggtgttcggaggacagaatttaattactgaaaacggaacatgcctggcggagtcgaaacggtttgcaaacgatacgatattcgcggatctggatctggaacgtctgaacaatgagagaagacgcctttccacgtatccggttcgtgatgacagcgcatattttaccgttggatttcatataacggaagaggagtatgacctggaacgccccatcgatccgatgccgtttgttccgacggatgaagggcagagaaacagacgctgcgaggagattttgtccattcaggccatgggcttaaagaagcgcctctcccataccggatgcagccatgcggttctcggcatttccggcggcctcgattccacgctggctctgctggtgacggtgcgcgcctttgacatgctgaagatcccgagaaatcagattcatgctgtgaccatgccgtgcttcggaaccacggacagaacgtatcagaacgcctgcctgatgacgaaaaagctgggagccgagctgacagagatcgacataaaggaagcggttacgattcattttcgtgacatcggtcatgacatcgacaaccataatgtaacctatgaaaatgcccaggcccgggagcggacccagattctcatggatctggcgaaccggttaaacggcatggtggtcggcaccggcgatatgtcggagctggcgctcggatgggccacctacaacggcgaccacatgtccatgtacggggtcaatgcgtcggtaccgaagacgctggtgcgccatctggtgcgctattatgccgacacgtgtggggaagaagaattgaaaacggtccttttagacgtgctggatacaccggtgagcccggagcttctgccgccgaaggagggcgagatcgcccagaagacggaagatctggtgggaccctatgagcttcacgatttcttcctgtatcagattctgcggtacggttaccgtccggccaaggtgtaccgtctggcgaaggcggcctttggcggagagtatgacggcgaaacgatcttaaagtggctgaaagtattttaccggagattcttcagccagcagtttaaacgttcctgcctgccggatggcccgaaggtgggctccgtcgcggtttcgccgcggggagacttacgtatgcccagcgatgccagcagccgactgtggctggaagaactggagggactgtcatgattaccagcagcgccaacggaaaagtaaaacaggtcatgaatctgacgaagaaggcgaaggcgaggaaagagtccggactgtttgtggcggaaggcctccgcatgttcaaagagattcccagggatcggatcgacagcctgttcgtgtcggaaagcttcttaaagaatccggagggcaggaaggtgatcggttctatgaattatgaggaggtggcggacgatgtgtttaagaccatgtccgatacggccacgcctcagggtgtcctggccctggtaaagcagtatgcatacacgatcgatgatattttagaccggccgggtccggcgctccttatgattctcgacaccattcaggatccggggaatttaggaaccatcctgcgcgccggagagggagcgggcattaccggggtggtcatgaacgacaccacagccgacatctataatcccaaagtaatccgttccaccatggggtccgtgtgccgtgtgccctttgtctataccgccggtttaccggagacgctggtcaaaataaaaaaacgcggtgtccgcctttacgccgcccatttatcaggcaggaataattatgagaaagaagattatactgttgatacagggtttttaattggcaatgaagccaacggtttaagcgacgagacagcggctatggcagacacgtatgtcaagattcccatgatgggaaaagtggaatcccttaacgcggcagtagcggcctccgtgcttatgtttgaggcggcaaggcagcgaagaaattagaaaatgcggcccgtcagaaaattgtaaggcatttttagacggtaaatgttgagaaatgtctgaaaatatagtatgattagtgcaaatgaaagatatgcctggcagctttgcctattactggctcaggaaggggattgataagatggcagctatctactggctcatagcctttgtagtattacttgggattgaagccgcaactatggccctgacgaccatttggttcgcagggggcgcactcgttgcatttgtactggcacttttgggtgtcagcgtacaggttcagcttgctgcatttgtaatcgtatcatttatactgttgttctttacgaggccgtttgccttaaagtacgtgaatcataacaccgtgaaaaccaactcggaaagtctgattggaaagcacgcgaaggttacctccgaggtgaataacaccgagggaaccggtgcggcggtattgaacggacaggaatggacggcgagagccgaagacgacggaaagatttatccggccggcacactcgtggaagtaaaagacatcagaggcgtaaaactaattgtaagcgagactcaggaggaagcgtagtatgaatggagcaataggtttttttgcagtcattatagtattaataatcattctggcaatactggcatcatgtattaagattgtaccgcaggcgcaggcgctggttgtagaacgtctgggagcctatttgggaacctggtcagtcggtgttcatatcaagatgccgattcttgaccgtgtggccaaacgtgtgaacttaaaagagcaggtggcagattttccgccgcagccggtgatcacaaaggataacgttaccatgagaatcgatacggttgtcttcttccagattacagacccgaagctttatgcatacggggttgagaatccgctgatggcgattgagaacttaacggcaaccactctccgtaacatcatcggtgatctggaactcgaccagacactgacctccagagagacgatcaacgcaaagatgagagaatctctcgacattgccaccgacccatggggcatcaaggtcaaccgtgtagagcttaagaacattatgcctccggcagcgattcaggatgccatggagaagcagatgaaggcagagcgtgagcgccgtgagtccatccttcgtgcggaaggtgagaagaaatccaccattctggttgcagaaggtaagaaggaatccgcgattctcgatgctgaggctgagaaacaggcggcgatccttcatgcagaggccgagaaggaaaagagaatccgcgaggcagaaggtcaggctgaggctatcttaaaggttcagcaggcgaatgcagacggtatccgcatgatccgggaagcgggagccgatcaggcggttctgacgatcaagagcttagaggctcttaaggcagtagccgacggcaaagcaacaaagattattattccatccgagattcaggggctggcgggtcttgtatcctccatcactgagatcccgaaggatcctaaataggaatgtgaaaggtaattagagaattcgcagcagggggcataagctctcgtgctgcgtttttctcattcaaataagtgaagcagccgcgatccggcgcggcatttgatctggcgattgcaggcaggaggcgtgtatggaactcaaactggatttgacaaaggaatacggtatcgttttagagggcggaggcgccaagggagcctaccagatcggggcgtggaaggcgcttcgggaggcgggcgtccgaattaagggcatcgcaggcgcttcggtcggttcactgaacggcgcgctgatctgcatggacgatttggagaaagcagaagatatctggaagaacatcgaatattcccgggtgatggatgtcagtgacgagaccataaaggcgctgaaaaagaaggatttcaaggcgcttaacatgcaggagattctaaacagcgggttccagtttatcaaggacggcggcttcgatgtgacgcccttaaagaatctgattgccgaggtggtgggagatgaatcccgcatcagggagtcagatcgggaactctttgccgtgacgtattccgtgtcggagcacaaggaactggcagtggatgtcaagagcggtgaagagggatcggtgaaggatatgctgctggccagcgcctattttctggcgtttaagaacgaaaagctgggaggtaagcggtaccgggacggcggcggcttcaataacgttcccctgggcgttttgctggataagggctatgaggatatcatcgtgatccgcatctatggctggggctttgacagcgaaaaggtgacaaagatcccggatggagccaacgtgtatcacatcgctccccgccaggatctgggcggaattctggaattcgacaagaaacagagcagaaaaaacatgactttggggtattatgacgcgaaaaggttcttatatggacttgccgggcgtatatattatattgatgcaccaggttccgagccgtactactttgataagatgatgtcggaactggaacttttaaagatttatgtcgaagaagatctggatcaggagacccgggagagcctgaatggttaccggatgtttacggagaccctgtttccaaggatggctgtggagtttaaactgaaagacgactggaactacagggatttatatatcgcgattctggaggatttggcgaagcggctgaagatcaaccgttttcagatttatacggtggaccgcctgatcggaaaaataatgatgaagctgcactctcttgacagccggattccattatagtaatgtaataggaagaaaagggcgcttcgtacaccaaatgtcgaatgatagaaaaaaagattgcatgtttatgcataatatactataatggtgtataaaaatacaaaaaagagaagtggaggaagcattatgaatttaaaaggaagaagttttattacattaaaggactatacaccggaggaaatcggatatctgctggatcttgccgcggatttaaaggctaagaagaaaaaaggcgagaccggaagttctctgaaagggaagaatatcgcccttatatttgaaaaaccatccacgcgtaccaggtgttctttcgtcgtggccgcggtggatgaaggggctcatcccgagtacttaggcaaggatgacattcagctgggacacaaggagagtgtcgaggacacggcccgcgtgctgggcagaatctttgacggaatcgaattccgtggatttaaacataaaacagtggaagatttggcaaaatacgctggtgtgccggtgtggaacggtctgacggacgattaccacccgacccagattctggcggacttacttaccatgaaggaacattttggttgcttaaaagggctgagctttgtctatgcaggcgatggacgcaataatatggccaacagcctgatgatcggtatgagcaagatgggcgtcaacttcacgattctggcaccgaagtgcttatggccgaaggacgagctggtcacgctgtgccagggctatgcgaaggaaagcggaagcaccgtcactctgaccgagaacgtggatgatgtaaagggcgcggatacgatctataccgacgtatggtgctccatgggcgaggaagataaggcggccgagcgtgtagcgcttttaaagccttaccaggtgaacgctgcgctgatggagaagacggaaaaggataccaccatcttcatgcactgcctcccggccgtaaagggcaacgaggtgacggaagatgtgttcgactcagaggcctccgtggtctttgacgaagcagagaacagaatgcacaccatcaaggctgtgatggtggcgacgttaggagaatagaacatgtatatacaggaacgaagcagaaacccgagaaacttgtccatgatgctggatgcggcccatattatcataggaatcctgatcgtcgcgctggcggtcatctcatttttgaacccggaggaccatatgctgctgtttccggtcattttcctcctggcggcatcgctcaatatcatgaatgcggtctttaagatccgcatgagcggccgcgaaaagaagaaaaaggcctcggggattctggttctcctgtttggaattgtgctgcttgccctcgctgtgatcagtgcggtcagcatctggtgggggtgagagcggtgaagacagagattttgaaagctataaaagaagaggccggattcgtatccggacaggagctgtgcgaccggttcggcgtgtcacggacggccgtgtggaaggccatcggccagctgaaggaagaaggatttcagatcgaggcggtacgcaataaggggtaccgtctcttaagcagcgatgatgtgatcacggaagccgagcttatgagcagcatggaaggcggatttatcaagaagatcgtatactatgaggagactgattccaccaatattcgcgccagaaagctggcggaggaaggcgccccggacgggaccctggtggtcacggactttcagaacgcagggcggggccggcggggccggatgtgggtatctccttccgggacgggcattttcatgagcctgatcttaaggccggacatccttccgtcatcggcctccatgctgacgctggtggcggctctcgccgtctatgacggcattaaggagacgaccgggcttgaaacggtcatcaaatggcccaatgatatcgtggcggaaggaaagaagctctgcggtattttgacagagatgagtgccgagctggaaggaatccactacgtggttaccggaatcggcatcaatgccaatatgaccgagttcccggaggaagtgggggaggcagccacctccctgcgtatcctgaccggaggcccggtgcggcgcagcaggctgattgccgctgtgatgaaggcatacgagggatactatgaaaagtttaagtcatgcggcagtttagccggcctcatggatgtatataatgaacatatggcaaatctcggcagggaagtgaaggtcctggatcccgcgggcgcctatacgggcaaagcgctgggcattgatgagaaaggcgagctgatcgttgagaaggccgatggaaaggtggtccgtgtggtctccggagaggtatctgtccgggggatttatggatatgtataagtatgaataattattctttttacgatcaactgcagacgctggagccgaagaaggacgagttttcgaaggaagagcggctgaaggccatggagaagccgctgctttcctggtacaagaaccatgcgagagttcttccgtggcgggaaaatcctgagccataccgcgtatggatttctgagattatgctgcagcagacgagagtagaggctgtgaagccgtattttgagcggtttatggcggcgcttcccgatacggcggcgctggcggcagtgccagaggacaggctctttaagctgtgggaagggctcggctattacaatcgggccagaaatttaaaaaaagcggcgggtgtcgttatggagcagtacggaggagtcattccggcttcctgggaagatcttaagacacttccggggattggatcctatacggcaggcgctatcgcctccattgcttatggaattcccgttcccgccgtggatggcaacgttttacgggtgatatcccgtgtgacggggagccgggaagacattttgaagcagtcagtcaaaaaacagatggaggagctgcttctcggcgtcatgccccaggagggggccggaagctataatcaggcgctcattgagattggggccatcgtctgtgttcccaacggggagccgctttgcggggaatgtcccatggcctctgtgtgcgtggcgaggcgtgacggtcttacaaaggagattcctgtaaaaacaccgaaaaaatccagaaggatcgaggagaagacggtccttattctggagtgggaggggcgcacggcgatccgcaaacgggatagcagcggccttctggcctccctctatgagcttccgggcgtggaaggatggctggaagatgaggcgcttgcgcagatgtaccgtgttccgctggcagcggtccgccggcttccggaggcgaagcatatcttcagccatgtggagtggcgtatgaggggatttgccgtggaactgcaggaaaaaccggccggagactacctctgggtgacgccggaagagatcagggagacatattcactgccaagtgcatttaaggcgtatactatgatgataaggtgagaataatgagaaaaatgctgtttatctttaatccacgttccggaaaggctcagatcagaaaccggttgatggatattctggatatcttcacgaaagccgggtatgaagtttcggttcatgtgacccagcggcctaaggatgccatggaggttgccgcggcaagaggcaatgacgctgacttaatcgtctgcagcggcggcgacgggaccttgaacgagaccataagcggtatgatgatgctggaccggattccggatctgggatatattcccgccggttccaccaacgattttgcctccagcttaaaaatcccgaagaacatgatcgccgcggcgcatttggcggtggagggggaagcgtatcctgtcgatatcggaagcttctgcggggacaggaatttcgtttatatcgcggcctttggcgcatttacggaagtgtcctacttaacgccccaggataagaagaatatgctgggccatcaggcttatatgctggagagtgtgaggagcctgacttccatcaagtcctaccgcctgcgtgtggagagcgaggagattacgctggaaggggaatttatctttggaatggtgacgaataccatcagcgtgggaggcttcaagggcctggtcacgcagaatgtggctttaaatgacggagaatttgaggtgctcttaatcaggacgccgagaacgcctctggatctaagcaacattgtcaactatatgttcttgaaggaagagcctaacgagtacgttcataagttcagaacgaaggcgctcacggtaattccggaagaaccggtggactgggttctggatggagaattcggaggtacacgcatggagactcagatcataaatctgcaaaaacagatccggattatgagaaatccttccaaaaaacaataaatctgcaatttaacgcagaaaaatgttgaaatatgtaatccggtagtatataatgaaaagttgtgtggacttttatgtatacttcttagcgaaaggacgttattaagtggaaaaagataattttttagagaagctggggaagctcgtggaactgggaaaatcaaagcataatgctttggacgtaacggagattaacaacttctttatgggggaatcactgaccccggagcagatggatcagatctattcgtacctggagaatcgcggcgttgacgtgatcccggtaattgacgactcgatactggctgatgatgtgctcctgtcagatgatgctctgctgctcgacgatgatctggatgacagctttattaaaggggcggacgaggaggatatcgacctcgatgccattgacttgctggagggaataggtacagaggatcctgtccgcatgtatttaaaagagatcggtaccgttccgcttttaagcgcggacgaggaactgcgtcttgcaaagagaaaagccgatggtgatgaagatgcgaaggaacgcttgattgaagcgaacttaagactggttgtcagcatcgcaaaacggtataccggccgcggtatgagctttttagaccttgttcaggaaggaaatttaggtcttattaagggcgttgagaagttcgattatacaaaaggttataagttaagtacatatgctacgtggtggattcgccagtccgtaacaagggcgcttgccgatcaggcaaggacaatccgtgttccggtgcatatggtcgaaaccatcaataaaatgtcaaaaatgcagagaaagctgacgctggaactgggctatgagccctccgtcactgagctcgcagacgcgctcgacatgtctgaggacaaggtaatggagatcatgcagattgccagggaaccagcttctttggagaccccgatcggtgaagaggatgactctaacttaggcgattttgtcgctgacaacaatgtggtgactccggaaggaaacgtggagtccgtaatgctccgtgagcatatcgacgcattgctcggtgatttaaaggagagggagcgtcaggttatcgtgcttcgcttcggccttgaggatggacatccgcgcacactggaagaagtgggcaaagaatttaatgtaacacgtgaacgcatccggcagatcgaggcgaaagcactcagaaagctcagaaacccggtgcggagcaaacgaatcagagacttcttgtaagaagcagaaaggaggcgtggcatgagagtgctcacgcctttttgtgctttgcaaatgtagatgcaggacggcaatacatacggagattttagacggcggcgggttccgcttcagcggagcatcggtctttgcctgtgaatcagagaaggagaaaaagaggatgaaccacagaaattatcagaaagagctggacaccatactggaagactttgagaaacaggggaaggtgccgagactgctgcttcacagctgctgtgctccctgcagcagctacgttctggaatacttatcaaaatactttgagattacgctgtactattataacccgaatatctatccgcttcaggagtatatgaagcgggtgaaggagcaggagaagctgatctctgagatgaagcttgcacatcccgtactctttcgtaccggcccctacgaaccggacgaattcttccggattgccaaaggactcgagaaggttcccgagggcggagaacgctgcttcaaatgttttgatttacggctccgggaagccgccaaggtcgcatctgccggccgctatgattatttcacgacgacgcttaccatcagccccttaaaaaatgcagagaaactgaatgagatcggagagaagctggccagggattaccgcgtggcgtatcttccatccgattttaagaaaaaagacggctataagcggtctgtgcagctgtcggaggagtacggcctataccggcaggattactgcggatgcgtctattctaaggaggcaggccaggctcagtaaagatggcaaacgtggactgaaacaacttgacacccaatgggaattgtaataaaattaacgataaggagtatatagattagaggataaaggagaaaatattatgttaacaaaaacacttactgttgtaaacccatccggacttcatttaagaccagcgggagttctttcccagacagccatgaagtttaaatgcgacatcatcatcgagtgcggtgagaagagaattgttgcaaagagcgtattaaatgttatggcagcaggcatcaagtgcggtacagagatcaacttaatctgtgacggtgaagatgaagaagaggctatgaagagcatgagcgaagcgatcgaaagcggactcggcgagatgtaatggacaagtttcaataagtgaatgatatgcagaagctggcggaaaggaagcgattcttttccgccaatttatgttatagttctgacgagggataggggaagatacatggcaaaattaatcataatcagaggcaattcgggaagcggaaaaacgactgtggccagagcgctgcagcgcagatttggagatcacagcatgcttatttcccaggatatggtccgccgggaaattcttcatgtaaagggcgaaaagaatatgctggctctgccgcttatgcaggagctcgtggcatatggccgggatcactgtgagataacgattctggagggaatcttaacttcccagtggtatgagccgttgttcgattctgcaaagacgctgtttggagacgcggtttttgcctactactatgacctgccttttgaggttaccctgttacgccatcagacgaagagcaacagggaagaatttggggaaaacgacatgcgtgactggtggagagagaaagattacctgaaaaatatttctgaaaacgcattgacggcggaaatgagcctggaggaaacgatcgagcggatttatcgcgatgtgacgctggcttaaggcgacgtgatttcagaaaattgagaaatactggatgaagatcaatttcatgcaaaaataccgctgaattgttaggtgaatacaagattaagaacaaaaattagaaaaataaaaagcctatgaacataaattgtcaaataaactgacaactgctgtgaaaaaaggggtttacaaatggaaacggatgtagtattatctaaaaaaagttgaagcacaggcagaggctggcagaagccggagatgccatggtaataagacagtatcataaaatatggaacacaggcccgacgacgagcatagaaagccgcgggtctgtgtttttttattttataggaaaaggaaggagtcctggttttttaccgcttccgctgctctgtgcttcaacggaaacctgctgtcgctttgcacccctgataaaagagtacagccagaaaggaatgaaattatggttaaaaattcaaaatcccccacagcaaggaaaacgccggaattatatgattccaggtttgagcatgacaactgcggaatcggagcagttgccaacatgaaaggagtaaagagccataagacggtggagcaggcccttcatatcgtcgagaacctggagcaccgcgccggtaaggacgcggagggaaagacgggcgacggagtcggcatcatgctccagatatcacataaattctttaagaaggtgacgaaatctctcggtatcgagattggaggcgagagagaatatggagtcggcatgttcttctttccccaggatgagcttgccagaaaccaggcgaagaagatgtttgaaatcatcgtaaagaaggagggcctggaatttttaggctggagagatgtggagacgcacccggagctgattggcgagagggcggtggactgtatgccctgtatcgcccagggcttcgtgaagaagccagccgacacggaaaagggactggattttgaccggaagctttacgtgtcacgccgcgtatttgagcagagcaacgacaatacatacgtggtatcgctgagcagccgtacgattgtatacaagggaatgtttctggtgaaggagctgcgcagatttttccctgacttacaggataaggactacgagtcggccatcgccgtggtacactcccggttcagcaccaacacgaatccaagctggatgagggcgcatcccaaccgtcttatcgtccacaacggagagatcaacaccatccgcggtaatgtggataagatgatggcacgggaagaaaccatggaatcgaagtattttaagtacgatatgcacaaggtgctcccgatcatcaatcaggaaggctccgattcggccatgctggacaatgccctggaatttatggtgatgagcggtatggaactccctctggccgtcatggtgacgatcccggctccatgggcccatgataaatccatgcctcaggagatcaaggatttttacagctactacgcgactatgatggaaccgtgggacggtccggcctccatcgtattttccgatggcgacctcgtcggcgcggttttagacagaaatgggctgcggccttccagatactacatcacggatgacgatcagatgatcctggcttccgaggtgggagccatcgacacagagcagaatcatgtggtgagaaaggagcgcctccgtcccgggaaaatgctcctgatcgacacggtaaagggctgccttgtgtcagacagtgagctaaaggaaatgtatgcgtcgagacagccctacggcgaatggctggattccaacttaatcgaactgaaagatttaccgattcccaacaggggagtcgcggacatgagcgcggagcagcgttccaggctccagaaagcctacggctacacctatgaggaatacaagacgatgattcttcccatggccttaaacggggctgagacggtatccgctatgggagccgacagtccgctggcggtcttaagcagaaagcatcagccattgtttaattactttaagcagatgtttgcacaggtgacaaacccgccgatcgacgccatcagagaggagatcgtgacttctaccgccgtgtatgtcggtgaagagggaaatattctggaggaaacagcggagaactgcaagattttaaaggtcaacaatccgattttaacgtgtacggacttgatgaagatcaaatacatgaagaggcccgggttccaggtggaggtcattccgatcacatattataagaatacttctctggaaaaggcaatcgacaggctgtttctggaggtggaccgggcgcaccgggacggggcgaatatcatcattctttccgaccgtgatatcgacgagaaccatgtgccgattccttcgcttctggcggtatctgccctgcagcagcatctggtgaagacgaagaagcgcacctcagtggctctgatcctggagagcggagaacccagagaggtacaccatttcgctgcgctgctgggatatggagcctgcgcggtcaacccatatctggcgcaggaatccatccgggcgctgatcgaaagcgggatgctttataaggactattacgcagcggtggaagactataacagcgcggtgctccatggaatcgttaagattgcctccaagatgggcatttccacgatccagtcgtaccagggagcacagatctttgaggccatcggcatttcaaagagcgtggtggaaaagtattttaccgatacggtgagccggatcggaggcattacgctggacgatatcgcaaatgatgtggatacgcttcactccatggccttcgatcccctcggtctcgatgtggatttaacgctggagagcgtcggaagccacaaggccagggctggacaggaagaacatctctataatccgctgaccatccacctgcttcaggaggcggccagaacgggaagctatgagacgtttaagcagtatacacatgcgctgaatgaagaaggccagatggtgaatttaaggagcctgattgacttcgattatacgaagcggaaggcggtttccatcgacgaggtggaaagcgtggaatccattgtgaaacggtttaagaccggggccatgtcctacggctccatctccggggaagctcatgagacgctggctgtcgccatgaaccggattcacggcaaatccaacagcggtgagggcggagagagtctggagcgtctgactccaggagccgacgggctgaaccggtgctccgcaatcaagcaggtggcctccgggcggttcggcgttacctcgcactatctggtgagcgccaaagagatacagatcaagatggcccagggagcgaagcccggagagggcggccagcttcccggaggcaaggtatatccgtgggtggcaaagacgcggcattccacaacgggtgttggcctgatatcaccgccgcctcaccatgatatctactccatcgaggacctggcacagctgatctacgacttgaaaaattccaacacagaggccagaatctcggtgaagctggtatctgaggctggagtcggcaccgtcgcggcaggcgtcgccaaggcgggagcacaggtgatcctgatctcctcctttgacggcggaacgggggcggcgccgagaaattccatttacaatgcagggcttccatgggagctgggagtggcggaagcacaccagaccctgattatgaacggcctccgcgacaaggtgatcctggagactgacggcaagctgatgacaggccgtgatgtggcgattgcctgtatgctgggggcggaggagttcggatttgcgacggctccccttgtaaccatgggatgcgtgatgatgcgggtctgcaatctggatacgtgcccggtggggattgcgacgcagaatccggagcttcggaagcgttttaaggggaaaccggaatacgtggtcaatttcatgtatttcattgcgcaggagctgcgggagtatatggcgaagcttggagtccgcacggtggatgaactggtgggacgtaccgatctgctgaaaaagaaggagcatatttcttcgaaaagggcggataaggtggatctctcagccattcttggcaatccgtatgccgataaaaagctggccggctataaccacaaatcggtctacgacttcgaactgggaaagactatcgatgaaaagatcctgctgaagaaattgagaccggcactggtgaatgggcagaagaagagcattcagatcgatgtttccaacacggaccgtgcgctgggaaccatattcggatccgagatcacgaggctgtacccggagggacttccggaggatacgtataccgtaaactgcacgggaagcggcggccagagctttggcgcatttatcccgaaagggcttacgctggagctggtgggagacagcaatgattacttcggcaagggcttgtccggaggaaagctggtggtctatccgccgaagggcgtgacctttaaagccgaagaaaacatcattatcggcaatgtggccctttacggggcgaccagtggaaaggcgtttatctgcggcgtggccggtgaacggttctgtgtgagaaattccggcgctaccgcagtggtggaaggcgtgggagaccacggatgtgagtatatgaccggaggccgtgtcgtcctgctgggaccgactggaaagaattttgcagcgggcatgagcggcggaatcgcctatgttctggatgagaaacgggatttgtataagagactgaataaagagatggtttcctttgaggaagtgacgaataaatacgatgttctggagctgaaggaaatgataaaggaacatgtggcttacaccaattcggaaagaggaaaagagattctcgacaactttggtgagtatctgccgaaattcaaaaagatcatgcctcacgattaccgccgtatgatgaacaccatcgtccagatggaggagaaaggcttgagcagcgaacaggcacagattgaagcattttatgcgaatacgaagaagtgagccgagaggaggaaaagaatgggaaagccaacaggatttttagaatatgacagagagacaggaagggcggcagatcccaaaagccggattaagcattatgacgaattccgccttccgctctcggaaaaggaacagaaatgccagggggcccgctgtatggactgcggcgtgccgttctgccagtcgggaatgatgatcaagggaatggtttccggctgccccttaaacaatctgatcccggagtggaacgatctggtctatacgggaacatgggatcaggcctataaccgcttaaaaaagaccaacagttttccggagttcacctcccgggtatgccccgcgccatgtgaggcggcctgtacctgcggattaaacggagctccggtcgccatcaaggaaaatgagggagccataatacggcgggcgtatgagacggggattgccggcccgaacccgccgaagatcagaaccgggaaacgggtggcagtcatcggctccggcccggccggtttagcggccgcggaccagttaaataagcggggccacagcgtgacggtattcgagcgggaagaccgcgtcggaggcctgctgatgtacggtatccccaatatgaagctggaaaaatgggtgatcgaccgcaaggtggatgtaatgaaagaggaaggaatctcttttgtcatgggagccgatgtggggaagaaccacaaggcaaaggacatcttaaaggattttgaccgcgtgatactggcctgcggcgcatccaatccccgcgacattcaggtgccgggaagagattcggagggaatttattttgcagtggatttccttaaatccaccacgaagagcctgctgaattccaacttaaaggatcagtcgtacctgtcggccaaaggaaagcacgtgatcgtcatcggaggcggcgatacgggaaatgactgtgtgggaaccgccatccgccatggctgtgcatcggttcttcagctggaaatgatgccgaagcttccggaaaagaggacgcccgacaacagctggccggaatggccccgtgttgcgaagacggattacggccaggaggaggccatcgccgtgtttggcaccgatccgagagtgtaccaggcgacagtgaaggagttcgttaaggataagaacggcagagtggcgaaagccgtgctcctgtcactggagccgaaaaaggatgaaaagacgggccggatcacgatggaaccggtggccggaagtgagaaggaggtcacagccgatctggtgctgattgccgccggatttttagggagtcagagctatgtggcggatgccttcggcgtgaagctgaacgcagggaccaatgtggagactgaggccggaacgtataagacgaacgcccggcacgtgtttaccgcgggagatatgcggagaggccagtcgctggtggtctgggcgatccgggaagggagagaagcagcgaaggaggttgatgagagcttaatggggtatacgctgctggagtaaatggcgaggggggattaccaggtggcgcggtggagtttggctggatcccagggagcggctttttcgggtgaggtggctgagggcgcagggtgaccaagggctatgacggtgatgggggataccttgggtgggaggtttagggcctgtgtcagcagcttttgccatggggtgtgggggagaactccgcaccagactgcgccaagggccaggctgtgggcgcagagaagaatgttctgggtggcggcggcacaggcttcacagaggaaatcgttagttccttctatattatggtcgccgcagacgacgattccacaggcggctcccgccagcatgcgggcgttgggattggcggcggagagttcggtgaggaggttccggtcttccaggagaaggaagtgccagggccttttgttttttgcgctgggcgcgcacattccggcgtacaggagtgtgttaagggcatcaggggttatgggagcatccgtataatgacgtacgcttgtacgggttttaactgcggtgatggtgtccatggcgcatggggaaagggaagggctgggagcggtcgggctgccggagggctgggccggggcgtcgagggacattgtgacagagacgggcaggggaaggccgcaaaaaccgagggatttttgcaggactttgtcgataagcataatgtaacagccgctgccgcgggagaggagcctgctccggtaagggattccgtttatggttccctgtacgtaaatggtgcctttgggctgatggaaaatctctctggcagagaacggcaggggcagataagtgagtctgccggcggtgtctttgaggatttctgcatggaaggtttgcataatgttctccttattaaaagtatccggcttttgcctggcaaaaaccggataggtgaaatggttattttattggttcagagcatggcaggcgcggagcagggcttcaggactgccgccgcggatagccggaatgagctgcttaagctggtcgtgaggtaaatcccaccagcggaccgcctccagctgggtgatgatgtcctggctgtaacgcttcctgattggttttgccgggagcccgcctacgatggtatagggttccacgtcttttgttacgacggctctcgttccgatgatcgctccgtcaccgattttgacgccggacatgatgacagcctcgtaaccaatccagacatcatttccaatgacgatatcgcccttgttgtcccatgattctgtgacttccgagatgggagtgccccattcttcaaagaataaggggaacggatacgtggacagggacgtcatcgtgtggtttgcacttgtaaatataaatctggctccgcaggcaatggaacagaagctgccgataaccaggcggtctctgttgatcgggtagtggtagagtacgttgttcttttcgaaatcgaccgggtcgttcacgaaatcgttgtacatcgtataggcaccgacggaaatattgggatctttgacgaccgcgtttaaatagacggtctgccggtctcctgttcttggatatatggtttgtgccggaatagacattgtgattcctcctttatggatctggtgttttggtgtccctctgctattccggccgctgcaatgcatcgtttcatctgtgtggacagcctccttttcttttgcagcctgctttggtgtcaggcaatgctttcctttattttaagcgatgaggggggatctgtcaaatccatgttgggggaaaataatagcgggaaatctttatttttctaaagatttcccgctgctattttccggcctttataccgggaaccgcggtctgcggtatgaaacgagtggaacttatacattgaaacggaacaggacaacgtccccgtcttttacgacgtattctttcccttccattctgacaaggcctttctctttggcggccgtataggtaccgcagtcgagaagatcctggtagtttacgacctcggccttgatgaagccgcgctcaaaatcggagtgaatcttgccggcggcctgaggcgccttggttcctactttaatggtccaggctctcgtctctgtggggcctgctgttaaatagctgatgaggcctaagaggtggtagctggcggcgatcagtttttcgagaccggactctgtgaggcctaagtcctctaagaacatcttgcgctcgtcttcctccagttcggcgatctcctgctcgatctgggcacagatgacgaagacttcgctgccgttttctgcggcgaagctgcggacttcctttacgtattcattggaagcgccgtcgtcggccaagtcgtcttcgcttacgttggcggcgaagatcaccggcttgtaggtgagaagatttaaggaggaaacgaattcctgagcatcgtcatcttcaagctccatgctgcgggccagcttgccatcctctaagtgagccttcactgcttttaagatctccagctcttttgcgagagatttgtcgttaaaggcactctttgccgtcttggagattcgtctctccagaatctctaaatcggagaagataagctctaaatcgatagtttcaatatctcttaaaggattcacgctgccatccacatggatgacattgccgtcctcaaagcagcggacaacgtgcacgatggcgtccacttctctgatgttggaaaggaactggttaccaagaccttcacccttggaagcgcctttcacgagccctgcgatgtccacgaattcaatgactgcgggcgtgatctttgctgagtcatagagcgcagccagctttccgagacgtacatccggcacgggaaccacgcctacgtttggatcaatcgtacagaacggatagttggccgattctgcgccggcctttgtaagagagttgaataatgtgcttttacccacattcggcagtccgacaatacctaatttcataattcattaccttcctctattttattaaacatttttaaggttgattttttcctgcaactaatatagaatagcatattatccataaaaataaaagagtcaaactgaactcgcgcctgtttttgtcgaattatggtcgaatatgtcgggcgaatatgtttgatttttggcatatcacggggtaaaataaagaaaacatgaaaggagaaaacaatggcaaatacggcagatattagttttgtgcatttgggtattacgattgaccatttgcagaacagtatctcgatatttggattccgcatagcgttttacgggattatcataggaattggaatactggctggtctctgggttgcgacgagcgacgcgaaaaggaggggacaggacccggatatttatctggattttgctctgtatggaattatcttttctattataggagctcgtatctattatgtcatttttgactgggagaattacagggacaacctgatttcaattttaaacttaagggcaggcggactggccatatacggcggcgtgattgctgcggtcataacgctgactgtttatacaaggaagaaaaagctttctttcttttcaatggctgacagcggctgccttggactgataaccggacagattataggaagatggggaaacttctttaactgtgaggcgtttggcggatacacggacagcctttttgccatgagaatcagaagagcgctggtcaacgagagcatgatatctcaggacctattaaaccacctgattgtgaaggacggtgtcgagtatatacaggtgcatccgacctttctctatgaatcagtctggaatttaggcgtgttagtattcatgctatggtatcgcaaacgtaagaagtttaatggggaaatgcttcttatttacctgctgggatatggtctggggagagtctggatcgaagggctcaggacggaccagcttatattctttaacacaggaattgcagtatctcaggcattgtcattggtattagtagtgatatcagctttggtgctcatctggaaacacagacagatacgattaaagagcaaaggagaagactgatatgatttcaaaagaagagttgatctacaagattgaagaggcaagagataaattaaacagaagtatagacaccgagcaggacagcagcactgtttataagagaagtgtagagctggatcaactgatagaacaatatatagtagccgggtattagggacacggcatatctggaggcggtaacgaaatcattcgttgccgccttatttttttattcttttttagaaaatttccttgctatttccttacaaatgtactaaaattaatctacaagtggtggaaagtggtacaaagtggtagagaatggaggaagagtggtgtaagctctctctctgacgtacaagcaggtgattagtatgttcatgggcgaatacaatcatacagtcgatgcaaaagggcgcttgatcgtcccatcgaagttcagagaacagcttggtgaagagttcgtcgtgacgaagggcttggatggctgtttatttgtgtatgataacgaagaatggaaagccctcgaagaaaaattgaaaagcctgccgctgaccaacacaaacgccagaaagtttaacagattctttctggcaggtgcatcttcctgtgaagtggacaaacaggggagaattcttcttccggctgtgctccgtgaattcgcaggcatcgaaaaagatgcagtgcttgtgggtgtaggaagccgcattgaaatctggagcaaggatgcgtggacagcagccaatacatacgatgatatggaagaaatcgctgagaatatggaaggacttggaatatgatgtttgaacacaagtcagtgctgctttacgaaaccattgacagcctgaatgtaaaaccagatggaatttatgtggatggaacgcttgggggcggcggacatgctctggaagtatgcagacgcctcggggaatacggaagattaatcggaattgaccaggatgcagacgctatcgcggcggcatcggaacggcttcgtgactatgaagacagagttacgatcgtgagaagcaattacgaagagatacaatcggtactaaaggatttaggaatcgaaaaggcagacggtatttatctggaccttggagtatcctcctatcagctggatacaccggaacggggattcacctaccgggaggacgacgctccgctggatatgaggatggatcagagaaacacacagacggccgccgatattgtgaatacgtacagtgagtttgatttatacagaattatccgtgactacggagaggacaagttcgcaaagaatatcgcaaagcatatcgtgagggccagagagacaaaacggattgagacaacaggagaattgacagagattattaaggaagcggttcctgcgaaagttcgtgcagtgggcggccatccttcgaagaagacgttccaggcgattcggattgaactgaatcaggagctggaggtcttaaataattctattgatacgatgatcgacttattgaaaccgggtggaaggctggctgttatcacctttcattcgctggaggaccggatcgtaaagattcgcttccgcaataatgagaatccctgtacctgtccgccggattttccagtctgtgtctgcggcaaagtcagcaaaggccgggtaatcaccagaaaaccggttgtaccgtcagaagaagagattgaagggaacaagagatcgaagagttcgaagcttcgagtatttgagcggatttaaaaagggaggaaaagagcatggctgctagaaagaatgtgcattcttaccgtagtgctgcctacgtacaggggaatactgtccgtaagctggaacctgcacgcgtaccggtaagacgttcaccagatgaagtacgccgtccggcagtgaaccataaagtcagacggaatcgtgaaaaagccttacagatggatttgccttatgttattatgctgaccatcgcagcagtctgtacgctctgtttatgtgtaaattatctccatcttcagtcttccatcacgacgagaattcatacgatcgagagcctggagtcggagctggaaacgttaaagactgaaaacgatgccctgcagacgaatattaatacttccgttgatttggatcatgtgtacaaggttgctacagaggaacttggcatggtctatgctaataagaatcagattcttcagtatgataagacggaaagtgagtatgtaaggcagaatgaagacatcccgaaacactaacaggcagaaaaatagaaaaaccaagatatttccaagatacatgcaggaaaagctggcgattaccgtcctggtagttacgctggctttgtttgcattggttatggtcctgtacgatttaatgaccaataaaaaggacgattttaatcagattgtgctgtcgcagcaggagtacgacagccgtaccataccattccggcggggcgatattctggaccgcaacggaacgtatctggcgacgagtgagaaagtgtataatctgatcctggatcccaagcagattatgtcggattccaacgcctacttagaggcctctgtgaacgctctggtagactgtttcggttatgaccggacggagatgatgaatctgatcaacgagaaaaaggacaagtactatatccgttacgccaagcagctgacttacgaccagaaagaaaacttcgagaattataaggaagaaaaacgggaagagtttaagaaggctggagagggaaagggcatccgcggcatctggttcgaggatgagtataagagaatttatccgtataactccgtgggctgtaatgtgatcggctttgccagagacgacggcatggatggaagcggcggcattgagcagtactataactccacgctgatgggaaccaacggcagggagtacggctatttaaatgacgactctaatctggagcgggtgatcaagccggcatccaacggcaacacggtcgtttccaccattgatacaaacgttcagaagatcgttgagaaatatatcacggagtgggagcaggaggtcggaagcaagcgggtgggcgtcatcgtcatggatcccaataatggcgaggtcctggccatggccaatgataagacctttgatttaaacaatccgaggcagctccgcccggagtacaccgatgatgtggtgaagcagctgggcattcaggaagccatagacgactaccacagaaagaataaggacgcggagcctctgacggaggccaacgtttacgcccactattccaatgatgagatcatgtccttcggaaaacaggtggcgtggaatcagacatggcgtaatttttgcatcagcgacggcttcgagcctggttctaccgccaagatattcaccgtggcggcgggcctggaggaaggctccatcaccggtaatgagacgtatacgtgtaacggaaagctggagatcggcggatggccgatcaactgtgtaaatcgatatggacacggtgatctgacggtggagcagggccttatgaaatcgtgcaacgtcgttatgatgcaaattgcccagaaagtaggaaaacagaaattctataaataccagcagcagtttggcttcggttccaaaaccggaatcgatcttcctggcgaggcggacaacaagacgcttatgtacaacgcggagacagccgatccggcttccctcgcaaccaatgccttcggtcagaactttaactgttccatgatccagatggcggcggcgtactgctccgtcataaacggcggctcctactacgagccccatgtggtgaaacagatcttaaacgagcagggatctattgtgaagaagatggatccggttctggtccgcgagactgtttcggaatctaccacgaagtttatcaacgaagcgctctataagacggtaaacgcccagggcggtaccggatctgccgctaaggtagagggttataaaatcgcgggtaaaacaggaacggccgagaaggtcggacgtgacaagaaaaactacgtcgtatccttctgcggctatgcgcccgccgataatccacaggttctcgtatatgtggtagtggacgagccgcacgtagaggaacaggctcacagtacgtatgcaagcaaaatcttccagaagattatgactgagattcttccttatttaaatatattcccggatacagatatcacgccgtcacttccggaaggcggacaggcagaactgccttcagaggaagggatcagcagctccacagagggttccacggaagaaggaacagaagagagcacggaagtgggtacactggaaaatggagagacaattccgccggaggctctcgatccttcggaagaagcggtaatcggtccgagcgaggaggaaggctacggtctgccgggcgcgctgcctggacagacgaatccggcacggatcccgacgaccgcatcctcgtccacagaagcttccgaaacggagacaaaggaagaataaaagcgcaggaatttcatatactgtaacaatgatgacggtggagcagcgtatgaattctaataaaacacatcacagagagaagatagccatcctgtttttcctgttatttcttgccatgacaggactaatggggcggctgttttttcttatgattttccgatccgcccattacagtgccatggcggaggacttgcatgaaagagagagaacaatcaaagcggccagaggcaatatcgttgatgccaatggaaccgtcatcgccaccaacaggaccgtctgcaccatttcggtcatccacaatcagatagaggaaccggatcaggtggtggcagttttaagcaaagaactgggaatcgaggaagattctgtcagaaaaaaggtagaaaaatacagttccagggagattattaagaccaatgtggacaaagccctgggggaccagatcaggacgtaccatctggccggggtgaaggtggatgaggactacaagcggtactatccctacgacagcctggcatccaaggtgctgggatttacaggaggggataaccagggaatcataggtctggaggtcaagtacgaggattacttaaaggggatgaacgggaagattctgaccatgtctgacgcggcgggtattgagattgaaaatgcagcggaggatcggatcgagcccatcgccgggcaggatctgcatgtgagtctggacgtaaatatccagaagtactgtgagcaggctgcgtaccaggtgatggagaagaaaggcgcgaagcgggtctccatcattgtcatgaacccgcagaacggagagatcatggctatggtaagcgctccggaattcaacctaaacgacccgttcacgcttccggaggacccgggagatgtgagcgccaaggagaagcaggagctgttgaaccagatgtggcgtaatccctgcatcaacgatacttacgagccaggctccacgtttaagatcgtgacggccgccgcggggctggaagcgggagtggtgaatctggaagaccatttctcctgtcccggcttccggatcgtggaggacagaaagatccggtgtcacaaggtggggggccatggttccgagacatttctgcagggaatgatgaactcctgcaacccggttctgatcgatgtgggccagcgcctgggagtggataattactacaagtattttgaacagtttggcctgaagggaaagacgggaattgatctgcccggcgaggccgccaccatcatgcataagaaagagaatatggggctggtggagctggccacggtctccttcggccagtccttccagattacccccatgcagctgattaccacggcttcagccatcgtaaacggcggcaaccgggtgacgccccactttggcgtgggagccgtcagcgccgacggcgaggtgattcacaactttacctacccggtgaaggaagggatcgtctctgcggaaacgagcgaaaccatgcgctatattctggaaaaggtcgtctccgagggcagcggaaaaaaggcgtatctggaggggtaccgcatcggcggaaaaacggccacttcggaaaaacttccgagaagcttaaagaagtacatttcgtcttttatcggctttgcaccggcggataatccatccgtaatcgccctgattaccatcgatgaaccgcagggaatctactacggcggaaccatcgcggcgcctgtcattgccgacatttttaagaatattctgccttatctgggaattgaagcaacagaggaaaaaactgtttcctcgtttcgattctatagttgattattcaggaaaaaagacgtatactactaactgtgttactttccgccgaacgaaatgagggggattaaccgctgctctgaaagtacgaatacataaaatattgaggtgtgacatgattaacgagacgatactggcgattatcatagcgtttgccataagcgcgatactgtgccctatagtaataccatttctccacagattaaaatttggtcagcaggtccgggaagagggaccggaaagccatttgaaaaagcagggcactcccactatgggcggtctgatcatattgaccagcattatcattacttctctgttctacgtgaaggattatccgaagatcataccgattctgttcatgaccgttggttttggtatcgtaggttttctggatgattacattaagatcgtcatgaaacgctccgaaggccttaagcctttacagaagataatcggacagtttatcattacgggcgtctttgcatactaccttctcaactccaaggcagtgggaacgggcatgctgattccatttaccggaggcttcgaaaatggcctctatatcgacctcgggatcttcttcgtaccgtttctgttctttgttgtgctgggaaccgacaacggtgtgaacttcaccgacggtctcgatggactctgcaccagcgtgacgatcctggtggccaccttcttaaccgtggtggccctgggggagagagcggggatcagcccgatcacaggcgcggtcgtaggcagcctcctgggcttcctgctgtttaacgtctacccggccagagtgtttatgggagacaccggttccctggcgctcggcggattcgtggcgtccagcgcctacatgatgcagatgcccatatttatcgcgatcattggatttatttatctggtggaagttctgtcagatattatacaaattacgtattttagaaaaacaggcggaaagagattctttaagatggcgccgatccatcaccattttgagatgtgcggctggtccgagaccagggttgttgccgttttctctattgtgacggcgattctctgcctgctggcataccttggactgtaaagaaggagagtaacctatgagtcagaaaatattagttgcagggagcggaaagagtggaattgccgcttccagaatggcactcgatacagaacacgaagtgattctctacgacagcaatgaggcgcttgacgcggaggcggtccggggacagtttaaagaggacgagacaattgaagtgctccttggagagctgacgaaggaggcgcttaaggacgtggagctctgcgttatcagtcctggtatcccgcttgatgccccgtttgtcgaggtgctgaaggcctgcgaggtcccgatctggagtgagatccagcttgcataccattatgccaggggaaagctggcagccataacggggacaaacggaaagacgacgacgacctctctggtcggagagatcatgagcgcgtactataaagaggtgtttgtagtaggaaatatcggaacaccgtatacgtccaccgcgctccgcacgacagaccagtcttatacggtcgcggagatcagcagctttcagctggagaccatcacggattttaaacccgacgtgagcgcgatcctgaatattacgccggaccatttaaaccgccataagacgatggactgctacatagatgttaagaaagggattgcaaagaatcagacgaaggaggatgcctgcatcctcaattacgacgatccggttctgcggcgattcggagagactgtgaccccgcgcgtcatctatttcagcagcagggagcttctctctgagggcatctgcctggatggcgatatgattgtaaggaaccacgacggtgtacgcatggagatcataaatatccatgacatgaatctgctgggccgccacaaccacgaaaacgtcatggcggcggctgccataaccatggagctgggagtgccgcttgagacgatacagagcgtgatcagggactttaaggcggtggaacaccggatcgagttcgtggcagagaaggcgggggtgaagtactataacgattccaagggaacgaatcccgacgcggcgatccaggcggttaatgccatgcctggccccacgatcttaatcgcgggaggctacgataagaattccgagtatgacgaatggatcagatccttcggcaaaaaggtgagatacatggtccttttaggccagacgagagagaaaatcgccgagtgtgccgcaagacacggctttaccaatgtcatgtatgcggaagacatgcaggaggcggtcagagtttgcgcatcctatgcgaatgccggagaatacgtgttgttgtcacccgcctgcgccagctgggggatgtttaacaattacgaggaacggggtgatgttttcaaggagtgcgtgcgcagtctgtaacaggatgcggctatcgctcactaaagttttggcgaggaggaatgagatggcggaaaacaggcctaacaagaagaaaaacaaaccgcgccgtttttatgattacagcctgctgtttacggtgatatttttgaccgtgttcggtctggttatgatatacagttccagctcctacgctgcccagataaagtatgatgatgcggcctattttatgatgagacaggcgaagattgcactggccggatttgtcatcatgctgattatctccaagatggattaccactggtacgcaagatttgccgttctggcctacgtcctttcctatgtgctgatgattgccacagcactgtttggtatcgaaagaaacggtaagaagcgctggctcggagtgggcggtgcctcaattcagccaacagagtttgtaaagattgccctgatcgtcatgctggcatccatgatcgtgcagatgggcaagaatatcaacgaaaagagaggcgtgctgctggtgattgtcaccacgctgcctatcgccggaatagtagcagccaacaacttaagctccggtattatcattgcaggaatcgcgtttgtcatgctgtttgtggcatgtaagaaaaaatggccgttttttgcctgcggattcgcgggcgtgggggtgctggcgtttgccggtcccattgcgaccgccctggagaagatcggtctgttaaaggagtatcagttaagccgtatcttcgtctggctggagccggagaaatacccgtccaccggcggctatcaggtgcttcaggggttatacgccatcggttccggaggactggtgggaagaggcttaggggagagtatccagaagatgggattcgtacccgaggcgcagaatgatatgattttctccatcatctgtgaggaactggggctcttcggagccgtgtcggtgatcctgatctttctgttcatgatctaccggtttatgctgattgcagacaacgcgccggatttattcggtgccctgctggtcgtaggtgtcatgggccacattgcgatccaggttatcttaaatatcgccgtagtgaccaacaccattcccaacaccggaatcacgcttccctttatcagctatggaggtacgtcggttttgttcctgatgatggaaatgggcatggttttgagcgtttccaatcagatacgtctggaaaaatgataacctttttcccgctttttacataggatagtatataagaagccacgggaggtatcggattgtcggtcatagaagtccaggggcttacgcccttagaaggtgagataaagatccagggttccaagaatgccgttctgcccatgatggcggcggcaattcttcataaaggcacgacagtgatagaaaatgtccccaggatacaggatgtgttctgtatgctggggatacttgacagtatcggctgtaaatgccgtttggaaggaaaccggctgaagattgatgcatccgtagttacagagacggaaataccgaaagagtttgtgaagagtatgcgctcctcgatcattgtttcagggccgctgttaggacggatgaagagagccgttaccagttttcccggcggctgctctatcggggaaaggcccattgacctgcatttgacggcgcttgacgcgctgggggcccgggtggaagaggacggagaggagcttttagtcactgcgaatgagctgacgggagccgacatctacttcccgtttcccagcgtgggagcgaccgagaacgcccttatggccgccgtgctggcggatggcgtgaccgtgattcacggcgccgccagagagcctgagatcgaagagctgtgcctgtttttaatcggcatgggagccaggatccacggggtgggaagttcaaaactggtcattgaaggggtacttagcctgcatgattccatatttaccgtaaccggcgacaggattgtggccggcacttatctttgtgcggtcatggccgcggagggctgtgtgaccctgacgggaatccggccatcccatatggaggcggtgctgcgctgtgcggaggagatgggagccgccatacggaggtatgacgaccgcatttccgtgaccatgacagggcgcccggcggattattcggttgtgacgggtccttatccgcagtttccgacggatttacagtcgccgatgatggcagtgatggccgccgctgagggaaccggccgtatggaagaaactgtatttgagggaagatttggcactgtaaaagaattgcagaaacttggcgcagatattataatagaggataacagggcagagatccgcgggctgtaccctttaacgggcgcagtcgtgagggccagggatttacgcggcggcgccgcactggtggtcgcgggtctggcctcccgtggtgtgacacagataacagactgcagccacatcgagcggggttatgaagatatctgccgggacttaaagagccttggcgctgtgattagaggaatggaatgataagaccagaaaaaagcaaacgaagaatcgtaatcggaattgtggcggcggttatcgtcttactggcggtaatcttaatgtccatccggattacagagattacagtaacggggaataaacagtataccgccgatgaactgcgcggtctgctgtttaaggataagtgggaccggaatacgatttactgcttttacaaggatcattttaaggaacatgaacagattccgtttgtagaagactataaaatcgtattccagagcccgacgagggtggaaatcatcgtttacgagaagagcgtggtcggatacgtctcctatatgggaagttatatgtatttcgacaaggacggtatcatcgtggagagctccagcaataagctggagggaattccatgggtaacaggactgaagttcggccatatcgccctgcatcagccccttcccgtggaaaacaccaggatcttcgatgagatcctgaatctgacgcagctgctgtcgacgcatgagattacggtggacaggatccagtacgatactcacggcaacgccagtttaatcctgggggacatcaccgtctatctcggaagcaacgaccagatgagcggcaagatttccgagctgaaggatcagcttcccgtgctgacaggcctttctgggacgctgtatctcgatacatatgacgaggctgagacggccacatcgtaccggtttgtaaaaaataaataaaatttccattcagaacttataattttgttgaaaaagtggttgatattttcggtaaaatcaaatattatattagataggtctatagagtaagctgtttatggttaaaggaggatataatcttgttagagattaagataaatgaggcggataatgctgcaagaattctggtaatcggtgtgggcggtgccggaaacaacgcagtaaaccgtatgattgatgagagcatcgccggtgtagaattcatcggaattaatacagacaagcaggcacttcagttttgcaaggcccctacggctatgcagatcggagagaaactgacaaagggactcggagcaggcgcaaagcctgagatcggtgagaaggctgccgaggagagctctgaggaactggctcaggccatgaaaggcgcggacatggtgttcgttacctgtggtatgggcggcggaacaggaaccggtgcggctcccgttgttgccaagattgcaaaagatatggggattctgacagtcggtgttgtcacaaagccgttccgctttgaggcaaagacacgtatgtcgaatgcgatcgcaggtatcgagcgcttaaaagagagcgttgataccttaattgtgattcctaacgaccgtctgcttgagattgtggacaggcgtaccaccatgccggatgcattaaagaaggcggatgaagtccttcagcaggcagtacagggcattacagacttaatcaacgttccaggcctgattaacctggatttcgccgatgttcagaccgtcatgacggacaagggcatcgcacatatcggtatcggcaaggcgaagggcgacgagaaggctctcgatgccgtgaagcaggccgtatccagcccgctgctggagaccaccatcgagggtgcctcccacgttattatcaatatttccggcgatatcagcctgatcgaggccaacgaagcggccagctacgttcaggagatggcaggagacgaagccaacatcatctttggcgccatgtatgacgagacggctcaggatgaagccagtattaccgttattgccaccggcctcgatatggggaatgagactcctgtcggcaaggtcatgacaagcttcggcggcagcgcaaccggctatacgagaccgcagaaaccggcggcacagccggcgcagaaccagaatcctaacccgaatcaggaagctgcggcaaccgcacctgcttacaatccgaattataacccgaactacggcaatccaaactatggaaaccagggatacaatccaaactacaacaagccgaattatggcggacaggccggtgcaccaggtgcttcccagggtgccggacagccttacagaccaaccgtaaacagagaagttcagatcaatattccggatttcttaaagaacaagagataagatgctgtgctgcgccgcgtcgtaacacaggattgaataatggggggtgctgcagatggccttagcaaagcgctaggactacctgcagcaccccttgttttaaacggaggagatactttatgtcggaagaaaagaaaaaccagggtgaagactgggagatgtcggaagagtattataagagcggggaaggggagaaagagctgtccctggaagattttattaccgaagaggatttacagacagatgggctgaaccttcagtccaatcacgacgagctcttaaagaagacggcggaggatgtgcaccgtgtgatggagctgactttgcagggaaataatatcgagaagatttcagaaatgacagggctggatagtcagtatgtatacaatatcctggtctgcgcgcagggcttccgcgaggacgatgagatcgcggtggctcatctcgtgcttggataaggtgctgtgagctttataatacgacggagaaagagggggaaagtgcgatgatgaagaagatgtgcccggtctgtgacctacctgtaaacgcggggaattactgtccgcgctgcagaagggtgatcaggaatccctatacgcagaacgtggattactatctcaatgagagacatccggagcatgagacggagtgcggcttccataatccatatctggaggcggatcaccacggagaaagcggtaatcctgccagcccggcttatggcagttcggctggccgtccggttcaaggccgttcggcacaggggagcccggttcaaggtggtccggttcaaggcagtacagttccaaataagcctgttcagagacctttttcgggcgcagctgcttccggtggaggacggacgccagggacaggcagtataaacggatcatacaggaatcctgcagaaggttccggggcgtaccgtacagccacaggcggttatggagcgggaagccgtccgacaggaaccggaagtatgaagccggaggggaagaaaagcaacgcaggaaaaaccgttctgattatggctgctgtcggccttgtcaccattgccatggttgcctttacaaacctggaaggctacttaagcgattacctcaaaggagctgcggagacgacggaggcatataattatgattatgaatccgactttacgaggctgaatgatgaggacgtgatagaagcgggcgaaccgtgtatggcttactaccattttccggcggatggcgtttatgtgagtgagcagctgctggctgctgtcgagagtactgactttggctataagcttgattccgacgaactctatacggataattacttatacgacgatacgtcttattttgaaagcatcagaagcctctatctggaggataacctgagtgagacgcgggacgacgagtacacagaccagtatatcgatgtgaactatgacactgcgaccaatgaacttcatgaatatgcgaccagattttacagcagcgaagcctcactaacctttctggagcgttttctgactgcgacagaggagagcagcggaattgcggcggaagaccggaaggccgatgagattatggaggaagccagagatattgtgaagcaggagcagagcagctatatctatgaagggctgtttgtcattgaaatttacagatatgagggggatgaagccctttatgtctatgcatcgtataatgatcctgagttgggctcagagttgtaggtcagggggctcggagttgggaagatatggtgtcaggaatcatatgatattttcttgacaatgtaaccggattgtgatatagtatcatcaatcgtaagagggagtagcttccagccccggggttggataagattgcgtcagaacgataaaggaacctttatccgcatacttatgaaatgtgcaagacttttattgataaccagatggctgtcagtaaaggtctttttttattacataggaaagcttgctttatgggatttcatagtctgcataaaggaaacgcggccgcgttttccgtgccctttacgagagaaaccagaaaaacgacagaaagaaaggcggagaaaatatggaaacatttgatcccagcaagaaaccaaagttgaataagataacaggtctgctcaagaaatcaggagtgatagcggtgttggtgatagcgattcctgtcatagggattggctctgtttataacattcaggaacaggagcaggcggtgctgacaaccctcggatcggcgaagacggttgcggagcccgggctgcattttaagattccgtttattcagcgggtacagaaggtgaataccaccatacagggtgtggcgatcggttacgatccttcggataaccagtcggaggaagcggactctctgatgattaccagtgattacaattttgtaaatgtggacttcttcgtggagtataaggtggtggatccggtgaaggctgtgtatgcgtctcaggaccccttcaccattttgcagaatatcagcagaagctgtatccgtaccgtcatcggaagctacgatgtggattcggtgctgacgaccgggaaaaatgagatacagtccagggtgaaagagatggttatgaataagctggaacagcatgacgtgggactttccgtggtgaacgtcacgatccaggattccgaaccgccgacagcggaggtgatggaggcgtttaaggccgtggagaccgccaaacagggcaaggaaacggcgatcaacaatgcaaacaagtaccgtaatgaaaagcttccggaggctacggcacagacggataagattttgcaggaggcagagtcttcaaaggtgcagcgagtcaacgaggctaacgcggaggtggcgaagttcaatgccatgtacgaggaatacagcaaaaatccggaagtgacaagaaagcgtatgttctatgaggctatggaggacgtgctgccgggaatgaaggtgatcatcgacggtaccggcaagacggatacgatcctgcccttagacagctttacaggcgcagcgggagctgcagcgtcccagaatgcaggaaatagcgcgacgggacagaattcgctgggaaacagtacaggagagcgtacaggaaatgatggaaaaagcggcatgaagcagggcgaatcgggaactcagagcacaggaagccagacagatcatggggcagaggaggcagcagaatgaaaaaaacattgaaaaaagtgactggaactattgcaggactggccgtcattatagtattattaggttcagttgtagtaacgaatgaaaatgagtataagctgatccggcagttcggccgggtggagcggatcatcgataccgcgggagttacactgaagcttccatttattcagacagcggacacgctgccgaagcagatcctcttgtacgatctggcggcgtctgacgtgattaccatggataagaagaccatgttaagcgacagctatgtgctgtggcgcattacggatcccctcaagtttgcgcagacgctgaattcttccgtagcgaacgcggaggggagaatcgataccgtggtttataactccgttaaaaatgtgatcagcagcatgagccagaatgaggtaatcagcggccgggatggagaactgtcccaggccattatgacaaacgtcggcgacagcatggctgaatacggaatccagcttctggccgtagagacaaagcggctggacctgcctgccgataataaggcggcggtttatgagcgtatgatttcagagcgcgacaagatcgcagcgacctataccgcagaaggccaggctgaggctcagaagatcagaaatacaacagaccgcgaaatcgccatcagcatttccgatgcgaaagcacaggcggcggccattacggcggatggtgaggccgagtacatgagaattatggcggaggcgtaccgcgatccgcagaaggctgatttttattcctacaccaggtcgctggaagcggcgcgggcttctctaaagggagacagcaatacgctgattctgcccgcagattcgccgatcgcccggatttttatggggcagtaagggcggatattacgaaagacaggagatttacgatatgaagatcaaagacatactggggcagggaaagcccacgttatccttcgaggtgtttcctccgaagacggaagataagtacgagtccgtagaaaaggcggcggctgagattgcaaagctgaatccggcctttatgagtgtgacgtacggagcaggaggcggtacgagccagtatacggtggacatcgcctccaccctgcatcatgagtaccaggtgacggcgctggcccaccttacgtgtgtctcctccacaagagaaaaggtgcacgaggtgctggaagagttaaaggccgcgggaattgagaatgtccttgctctgcgcggtgatatcccgaaggaagggcctgtggcatcggattaccgttttgcctcggagctgatccgggagatcaaggcctgcggcgatttctgcatcggagcggcctgttatccggagggccatgtggaatcggtcagcaaaaccatcgatatggactatctgaagcagaaggtggaagccggatgtgactttgtgactacccagatgttctttgacaataatatcttatataattatctgtaccggatccgggagaaagggattacggtgcctgtcgtggcgggaattatgccagtgacgaatgtaaagcagatcatccgcagctgccagctctcaggaacgtatttgccgtcacggtttaaagcgattgtggaccggttcggagataatccggcggccatgaaacaggcggggatcgcctatgccacggagcagattatcgatctcattgccaatggagtggacgcgattcacgtgtattccatgaataagccggatgtggcggcaaaaataaaggagaacctgtcggaaattctgtaatggatttaaagcgggtcctggtgagaagtggagtgatatgcatggaaattaaccggagagagattcgaaggtatctgggatatggcagacaggaagcggatgaaaaggtttcgaagctgattgaagaatgtgtggaggagctggaggccgcggcgtcgccgaaaagcatatacagagtataccctttcgtgcctttgccggaggaagagctggattttacggtgtttcggacgaagagccggagtctcagccgtaatctgaaggactgcgaacaggtcattttatttgccgctacccttggaacagaggcagattccctgatccgtaagtatacaaagctccagatgagcaaggcagtgaccatgcaggctgcagccaccgccatgattgaatcgtactgtgacgaggtgaatacggcactgaaagagtcctttgagaaaaaagggctctatctgcggcccaggttcagccccggatacggagattttcccctggaatgccagagggatatcacctccgttttagagacggccaagaggatcggaattatgcttacagacagccttttgatgactccttccaaatccgtgaccgcggtgatgggagtgagcccgaagcctcaccgctgtgaggtgaggggctgtgaattatgttcgaaaacagactgcgcgtacaggagaggataagggatatgacagagttaatggaagaaatcaggaagagaatcgtatttttcgacggcggcacgggaagccttctgcaggcaaatggactgaagccgggagaactgccggagacgtggaatatccttcatccggagattgtgacaaagctgcattacgattatctggaggcgggagccgacatcatcaagacgaatacctttggagccaacgggctgaaatttaacgattccagtgaatatgggctggacgggattgtgacagcagccatggaaaatgcgaagaatgctgtcgggaaagccggaaaaaacggctttatcgctcttgatatcggacctacgggaaagcttttgaagccgcttggtgatttggggttcgaggaggcgtacgggctgttctctgacgtcgttaaaatcggtgcgcgcgagggcgctgatcttgttttgatagaaactatgagcgacagctatgaggtaaaggcggcagttctggctgctaaggaaaactgtgatcttcctgtcttcgctacgatgatttttgacagcaagggcaagcttctaacgggaggaaccgtggaatccacggtggctctgctggagggcctgggcgtggacgctctgggaatcaactgtggtctgggtccggttcagatgaaggggatcctggcggacatcatgaaggcggcctcagttccggtcattgtaaatccaaacgccggacttccgaggagcgaaggcggaaagacggtctatgatatcgatgcggatgagtttgccaggaccatgagagagatcgtggagatgggagcctgtgtcgtgggcggctgctgcggaacaactccagagcatataaaaaagaccattgaactctgtaaggaccatccggcccgcatgccggagaaaaaggactataccgtaatttcttcctatgcgcaggcggtcgttatcgatcagaatcccgtgcttatcggcgaacgcatcaatccgacgggaaaatcgaagtttaaacaggcgctccgggaccacaatctggagtatattctgcgcgagggtgtcactcagcaggataacggagcacacgtgctggatgtgaatgtgggcctgccagagatcgatgaggcggcgatgatggaggaagtggtgagggagctgcagagcatcatcgatcttcctctccagatcgatacctccaatatccaggccatggagcgggcgctgcgtgcctacaacggcaagccgttacttaactccgtcaatggaaagcaggaagtgatggaggaggtatttcctctggtgaagcggtatggcggcgttgtggttgcgctggcgcttgacgaagacggaattccagagactgccgacgggcgtctgagagtggcggaaaagatctatgcgaaggcggcagaatatgggattgagaaaaaagatatcatcatcgatgcactctgcatgacggtcagctcagacagcaaaggggcgattactacactggaaacagtcagaagggtgcgggatgaactgggaggaaagacgatcctgggtgtctccaatatttccttcggccttccccagcgtgagattgtcaatgcggcatttttcaccatggcgctgcagaatgggctgaatgcagcgattatcaacccgaattccgaggccatgatgcgttcctattacagcttccgggtgcttgctgatttagacccccagtgcagcgaatatatcagcgtctacagcggtcaggtggccacactgggccagaccgtgcgtcaaggcggcggttccggtaaatcggatggaagtggaacggcgatgtctgcctctcttgcagagagcattgagagaggattgaaggagagtgcacatcaggcagttacggagctcttaaagacgttagagcctcttgttatcataaatgaggagatgattccggctttagaccgtgtcggaaaaggttttgagaagggcacggttttcctcccccagcttttgatgagtgcggaagcggctaaagcagcttttgaagtcattaaggagcagctggcgaagtcgggcaaggaagaggaaaagaaggggaagatcattctggcgacagtcaagggcgatattcatgacattggaaagaacattgtcaaggtgcttctggagaactatggctatgacgtcattgatttaggtaaggacgtgcctccggagctggtggtggagaccgccgtagagcaggaagtgaagctggtaggactcagcgcactgatgacgactacggttccgagtatggaagagaccataaggcaactgcagaaagcggcgcccgaaacaaaggtgatggtgggaggcgccgtactgacggaggattatgcaaagacgatcggggcagaccggtattgcagggatgcgatggcttcggtgaattatgcggagagtttgttttcggttgaatgaatggttgacggtagtggagtgtgtttttaacagcaaaaaagaacaattgtttttttataacagttgttcttttttgttactgctaatattataatttcaatcctcgattctctattttaatagaaaaatcgccatatattagtttatcataaaagtcggaagaaaacaaagtttctataaaataagtagtaaatatataaaaacatatacttgtaaaatattactattagtattataattaaattatgaaaaatatacaaatgatgaagggagaatatcatggatgaaaaagaaagtgacaatagaaagttaaaagttgtagaaaatattagagaaaattatcagtcacttgaagggatgatttcaaaacaactttttatgggaaatgaattgcacggccctacgacaggatcttttcgagaagaaatttgggcagggttatttggacagattttgcctaagaagtttgtaattgagcaatccgcttttattattgattctgaagagggaatatccaaagaaatagatttggtaattatggatgaaatgtatacaccgtacatatttcgatacggaaaattgaagtttatacctattgaagcggttgcggcagtagttgaatgtaaaagccaaagcatagatgaacgttcagtcaaagagtggggagctgaaataaaaaaattgcgcactgcaaaagaatccgttgcccgtttagctaatatgattacaaagggtcctacaggtacccagttgtcaacgagacccattagaatattgtgtgctttggatcagaatatttcggctgagataaaagaaatttttgattttgttttgctggctgcaaataaaaatttagaaaaaacatacataaaggtgctttccaatacagcgtttagcaatttgtatgaatggtttaaagcattgaatttttatgaagttaatgaagcggatatggaggaacatatagataaaagcagaagtagaattgacaaagctgagctggaaaaaataaagatggatgagtatcaggtactggataaagaaagcaggccaatatcacttatgactttcaattttcagttgaatcagcttttaatgttgattaataaccctatgctttttccccatcgcgcatatgtaaaattatttagtaaagattagggaggaaaacaatggcagttcgaattgttacactatccatagacaaggttcaaacatttttgtttgatacaattagcgaacatacgcaaaagagtcaaatgaacagcggcacgttgcaaaatattatatcttcttcgagaatcatatctgaagatttatttcggatgattggagtagaaggaaatgatggattcttttcaggtatggtgaaggagatactattaaagtgttccggtgtctgtattttttcgacggatctagaggaaagacaaataaaagaatctttgagaaaaatctttgagttctattatagggaatatgacggtaaactttttataaaatatttgtgctttgaaactgaagtggcatctgatactgataaattgcaggtgattagaaagtgtaagaaacggttaaaaagtaagagttgtctgaatgaagtaataagagaaaatcggcaaataatctttgaacctcaatacagtgcagataagagagtatggactgatgaaaaaaaatatccgatgtttgaagaaactatcaacaaactttattccaaagtactgacagataatgaacgttattttcgtattgctgttatcaaagcggacctggacggaatggggcaattatttgaaggaataaacagttttgagcagtataaaagaatcagcgaaatcctttccaagtatatatgtttggattctttagcagcgacaacagaagcatttaagaaaacagatgatgattttaaattatatccgctttatattgctggagatgatattttatttgcggtgccagcctcttatatcgttaccggtgttaatttgtgtaaagtcatcttgagagaaataaatgatgaattagaaatagaggcagattatgaggaaaaatttacaatatcaatgagcattggaattgagttcactatcaatagagaaccgattcgatattattatgaacgtgtacagaggcagttggagtgtgcgaaaataacagattctgaaggcttgaaaagcatgcagccgcatattcggatctgtatgaatcaatacgtgttttttgattgtattgacaaagatgctaaaccacagtcgtggtctcactttattcatgatcttaaaattctaaaaagtgcggagtcagaaggatttaaagttcatcactttatgtatggattattaagtaaaatcacagatccagctgtaagagaacataaactgaaatacagcaatgcagttttttatcatttgataccgtcttactttgaaagtaagtcaaaattgggggagggtgagttattactcattgatctgttgcttaagcaggtggtagaaaaaaaagggagaagttcggttataaaattttatgataaagatggcagagtaaaagaaaaattcgaacagtatataagattactgctacttttttctgacgaacgttttcatctgacggatcatatccctgattacgatgtgagcaactttgacattcaaaaaaagaatattagaacaaatgtatttaacagggtattacgatatctgtatcaggagagtcttttcaattctgtaacaagtggggcggttgattctgatcaaatcaaaaaaatgcgggatttatttgtgattgatacgaaatataagaatcaatcaggaaaagatgtacaagtatatcagacattgcgtttatcgaaatcattgcttcatcagatgaaaagtttaggagcagatccagatttggatgcaaaattgattcagttaaatgttttaaaaactaaggaaaaatatgaggtgtcagtggagacacgtaaggctggctgcaagccgcctccatcgttatattttgatgaaaagcgttttttagatatagcaaaatcaacaaatttgtggaaagaagattatattgatacgctgttgatttttaatgctcttaatgatcaattaataaagtacaagattctatatcctacaacaaaaaataaaaaggacggaggagtaacaaagcatggaaagaatagatataagaataacgacaaaaacaaacctgtttatcggtgatacaccatcgacgtttgagattggaggtatcgatgcggcaacaaagataaattatcaggggttaccggtaattccagcatcttcttttaaaggagttttaaaaagaattatacgtgatatggcagcggctgataatcagcaggctaaaaaaatagaagatgcatatagagcgtatttgaataagctatggcaggaaaatgataagcgtattaaaaaaatgagtgagaatgtggaagaagaacgattgaacagaatggctgaacgttttagggtggtgatagaaaaggcttctgtcgaatatatttttggtattatgggatttaatgatacaccaaaattaattttcggtgattttcttccagcagaaagggaggcacaggaaaactatttttctatagattctaaaaatgctattatggattctgcagtagataatggcttaagatctcttccgcgtgtttataaaaccgtcagaccagagattgctttctgcggaaatattttgctgtatcgcatggaactcctggaaatggatggcattgaagaatttattaaaagtgcggtattagaatttaacgatgggatatatcggttgggcaattcaggaagtcgtggttatggaaggatagagacggagatcgtttagggggaatataaagtatggcagatatagaagtatatagagtgaagatggatttatcaggggaacttactcagattccagattcgcagaagctttttggtgctttgatttatatgtatgcggaatatacaaatgatgatacagcttctggcttcgtttcaaaaataaaggaaaaaaagatttattttgcgctgtctgatttgcttccagacaattatttgccaattcctcagacatttttgttggatgaactggcgataagcaggggaagattagataaaaaagtatacaaagcaatgaaaaaacggcgttatatcgaaaaagaacatttgatgaatctggtccagaaaagagaagaggtagaaaatgcatatccatatatagcgatccaggattcccagcagatacatgcgtctatagacagtctgagctatggattagcaggtttagaccccaatgtatattcggttccgcagatcagagctgtgaagattgagaaagctggggaggaatcagggagtctggtaaagaattatgaattttatctggctatagaaaaatgtaaagaggcatcagattttcttcggattttacaattagcacgacaaaataagagacctttttttctggggccacgcgcgtcacagggtatgaatatattttatatgggagaagtgttttttcagtcccaattctaccagcataatgttaaacgttatttgaatttagggatgttattgccagacaaaattaattatggagaatccagtttacatctgtttacatcggaacggcgtccttataacaaaaaagaaggctgggataattcttataaaagaaaattcatcagcttcattcaggctggcagtgttatttgtgtaagaaaaaccattcgtgaggtgggacggtccatttgtaattctgaagacgagaaaacaataatttttggaaattcatttttgtatccgatggaaggagatgcaagtgatgcatacgaaaaatattgagaaatactgctgtcgaataacaacatattcaacagttgccctttccccaagaggtcaggctgggtattacgaagggatccattttaatcaggctgatattaataaagagggggaagaaagaaaaatcagtatcatctatccgttctaccagtatggatgctataaggagtatagccccgagcatacacagtattatataccaggctcttccataaaaggtgctattggctcaagtgatctgggaatagatgatatgccagtgaagtataaggatatcaaattgagaaagctttataaagtgcaatatgcttcggagacgggagaagctgcagaaaataagaagaaggttaaattcgatgagttttttaagcaactggaaatcgaaatgttgaatagggatgtatctttatctggtgacgctttttgcaagggggatcctgagcttgttttatcaaaggctaagtcgaatacagaacaaaaattattacagcttgataagaggctgaaagaaattattgaaaatgacattataggtacggagggcgacgatacaactaatacaaaaggtgtattattagaggtgaggggaaagataaaagaaatgatgtaccaatctcaaaacttaggaaaaaactctgcttttatatttttgggcggttataaagggcttttattatcaaaggtttacggggatgcggatccattaaatggaggtatctatattgatcgagaaaataatttaccgcatggtcttgtaaaaatttcattagaacggagaagtgatgactgatcgtcataagactcatttttcgcttaactatctgcctcttttgatccagctaaaatgccatgaaacagcttcgctgccagattatatggggtcaacacttcatggaattatggggtgggcgttactgcctcataaagatgtatatcagtatttatttgagaatcgtagttttggaggcgcgaagcaggatattataaatccttatattattgaaccgccgggcttccatggagtatataaggctggagaagaactgcgtttccaatttatattgttgggagatgccgtgcagtattgtgaaccggtgataaaaattctggcagaaacccgatggtttaagatgggggcagagagaaaactttttgaattgacagagatacgacagggacagacccttcaactgatctggaagaacggtggggtggaatggaaaaatgcagtaagccaattagtgccagatacagctcagaaaaatagtacgtatggttcaatccatttcctgacaccattgagaatacgacgtaaaggcagattattattaaccgttgattttccaacaattattagaaacataacgagaaggatgagcgatttaacagagcgatatggggggtatgtggattttgcggaaatcgaagcattgcagtacctctccgaaatggtgcaggaagtatcgtctggagtatatttaaataatatagacagatattcaaccagaagaaatatgaaaatggatttaagcggattaatgggagctatgacgttccaaggagagttatcagtattcactccatggctgaatgcggcctctgtcttacatataggcagaaatgttacatttggatgcggaaaaattgatgtggtgtttggaaatatagaataatctaaaaaaactaataaattatcgggtgcgaacgtcaagtgatcgtgaaaatgcctggaggttcgcacctgaaaatgaagaaatcggagatgaaatttaattgttttattagaaataaagtgttaaaatagaaatatagacaatttttggttagtttgtgatagattgtgttgctgaaattgtgcagatttgctgtcaccactgatgcagtggtgtggattgaaatgacgttattatcggcgaatacacagcggaaaaggtcaccactgatgcagtggtgtggattgaaataatatacgtgatgttctgcagcgcttccgtaaaatgtcaccactgatgcagtggtgtggattgaaatagcttcacttacaccgtccatacgtaattcttttgtcaccactgatgcagtggtgtggattgaaatacacagccagagcatgatgcctttaagtcttgtgtcaccactgatgcagtggtgtggattgaaatttcataatctgtttctccttgtaaaaggcatccggcgtcaccactgatgcagtggtgtggattgaaattcggactaatttatagacatatactttgcacattgtcaccactgatgcagtggtgtggattgaaatcgtataccgtcagatagtctgtggtctcctccagtgtcaccactgatgcagtggtgtggattgaaatagacctcatatgtaagtcttgcaaaggcaggaagtcaccactgatgcagtggtgtggattgaaataataatcagctgtcttagttctccactactcatagtcaccactgatgcagtggtgtggattgaaattttttgagcctttaaggatatgtcgtattggtcgtcaccactgatgcagtggtgtggattgaaattttgcagtcagatcctgatcctcgataatgtcctcgtcaccactgatgcagtggtgtggattgaaatccctatggtttcgtatttaacgattccatgggatgtcaccactgatgcagtggtgtggattgaaatgtggaattgaaaacggagaagggacagctttcagtcaccactgatgcagtggtgtggattgaaatatttcggcatttccgtatccgtagggcgttgattgtcaccactgatgcagtggtgtggattgaaatcttaaatgattatcagggctattatgatctcgtcgtcaccactgatgcagtggtgtggattgaaataggaggtagaggccgcgattattcagcggggcgtcgtcaccactgatgcagtggtgtggattgaaatcgctatatcgaggacgtgcgcgtcgtgaacaagatgtcaccactgatgcagtggtgtggattgaaataggaggtagaggccgcgattattcagcggggcgtcgtcaccactgatgcagtggtgtggattgaaatttttttgcaaattgtgatacgcggtcgtttgtatcgtcaccactgatgcagtggtgtggattgaaatcaggaggtcttagagaaaacacggacaaatctaagtcaccactgatgcagtggtgtggattgaaataacccgttggatggcgaaggtgtaagggacacgagtcaccactgatgcagtggtgtggattgaaattttctctcctgttgccatctctctgatataccggtgtcaccactgatgcagtggtgtggattgaaatagcatgaccggacgcggatcctgaaggctctggaagtcaccactgatgcagtggtgtggattgaaatcttcggtcataccggaaatactaagtttgtttaaagtcaccactgatgcagtggtgtggattgaaattttagaaactgggttcacagcaagtgctgttattgtctccactgatgcagtggtgtggattgaaattatcgaaatacgatgtccatctaatgcagtagccgtcaccactgatgcagtggtgtggattgaaatctataacaggaatgtgattcttaaattcccaccagtcaccactgatgcagtggtgtggattgaaattgtgtttcccactacttcgattctgtaacggccccgtcaccactgatgcagtggtgtggattgaaatgctaccttccatcttgttatatggtcctcaactgtcaccactgatgcagtggtgtggattgaaattacgaatgccgggcgcatacccggcaggattacaagtcaccactgatgcagtggtgtggattgaaattctcattgttgacaatttgaatcaccttccctcgaggccaccactgattcagtagcacaaatatatatactcttaaataagacagtagatatagtcatatattctggctgtcgtatcagtgtaaaaaggaggtatttcatgttccttgcccacataagccaagatcaaactcgagagcaaacgatcgctgcccactgtcatggtacagcacatcttgccggtgattttgcatcttctttcaagtgtaaggaatgggggtacggttgtggcctgatccatgatatcggaaaatattcggaaaagtttcaagaacgtcttcatggaggaagcatcacggaccatgcgacggcaggcgcccaggaattatataaaagaaaaaatatctatgcagcctactgcatttccggccatcattcgggattgctgaatggcgggacttgtgccgattgtgcaggagaagccacttttatgggaaggatgaaaaaggggctggaagattatcatgcttacgaagaagaaatagaaattcctgattttccggtcccgcccctgcagcctttgggggaattcggttttactgcctcgtttttcattcgtatgctgttttcatgtctggtagatgctgattatctggatacggaaggttttatgtctgaaaatccggtgcctcgtggaacgtatgatacaatgagcagtctgttccagcgtgtacaggactacataatgccctggcttacgaataccgacaggaatacggttaacgggagacgaacggaaattttaaaagcgtgtttggaaaagggaaaggagccgtccggactctttcaattgacggtgcctactggcggaggcaagacagtttcttctctggcattcgcgctccatcatgccatccggcatgacaagcagcatgtcatttatgtaattccttatacgagtattattgagcagaatgcggctatatttaagaatattctggggtacgaaaatgttttggaggatcattgtaatgtggtattcgagagcgaggaggaattggggcggtcccaactggctgcggaaaattgggacaaaccagtgatcgtaacgaccaatgttcaattttttgaatccctgttttcaaataaaacatcaaaatgcagaaaactccataatattgccaacagcgttattatttttgatgaggcgcagatgcttccggtgagatacttgcagccatgtatacgggcaattaccgagctgattgtcaattatcgctgcagcgccgtgctgtgcaccgcaactcagccttctttgcaagcgtttttcccgggtacaatgaaatgcgaagaaatatgcccggatgtaaaggggcagtatgagttttttagaagaaccgacattcaggaaataggggaaatatcggaagaacagttagtcgctttattaaagcaggaaacccaggtgctgtgtattttaaacagtagacggcaggtacagaaaatttacgaggcggtaaaggaaggggggacgtatcatttgtctactctgatgtatccggagcatcgaaagaggctgcttcgggagataagggatcgtctgaaagagggaaaaacgtgcaggctgattgctaccagccttgttgaagcaggagttgattttgattttcaaatggtgtacagggagctggcaggaattgattctgttatacaagcagccggaagatgtaatcgtgaaggaaaaaggaggaaggatgactgccatactttagtatttaccctggagaaatcagcggatatccatcttccgccggaattaaaacagcccattgtggctgctgaacagactgcagaaaaatatgaggacattgcgtcactggaggcaattcaaggatatttcaaacgtctctattattataaaggggaaaaggggttagacgtaaaagggattgtggagcagctggaaaagggcggccgttcccttttatttccatttgcagatattgcagatgagttttcattaattgaagagggcaacacaaagacgattctgatcgatcaggaacttaaggcccaggagattgtacagcgaatacgctggggtgaacactcccgtcagcttgtccgggaagcgggacattatagcattcatatatttgaaaaagattttgaaaatttaaatggcgcaggtaaactggaggcactggatttaaaattctatcgtttgagaaacccggagcagtataccaatgaaatgggattgattttgaatgcagaaagaggggaggcggtctttttataattattatagaaagatgatgattggaaggaggaaaaacatgagccgtggtgtacgggtgcgggtatggggggatttggccctcttttcccggccggagatgaaagtagaacgatgcagttacgatgtgatcacgccctcggcggcgaggggaatgctggaggcggtctactggcatcccggtatgaaatgggtgattgacaaaatttatgtgagaaagccgatccagtttaccagcatacgccgaaatgaggtgaaaagcaaggtcttagccagcagtgttttaaatgttatgaatggaggaaataaaccgctgttgatcagctgtcgtcaggaaattgtacagagggcggcaattcttcttaaggatgtggattatgtaatcgaagcacattttgacatgacagatcatgcgagcgactgcgataacccggggaagtttaaagacattattatgcgaaggctgagacggggagagtgttaccatacgccatacttcggctgccgggaatttcctgccaaatttgaactctacgagggcgacgatgtaacgacggaatataaaggtatggaaagggaactgggctatatgttctacgattttgattattccaatccggaagatatacagcctttatttttccgcgctgtcttaaaggatggagttttagatgtccgggatcaggaggtggtacgatgatcctgcagtctttggtaacatactatgagagtttggaacgaaaggggaaaataaccagtccaggctggtgttcggcaaagatctctttcgctttggaactttcagaagctggggaactgctccgcatcattcctttgaaagagtcagtcttaagggggaaaaagaccgctttagtgccaacgatcaggaaggttccgcagatggtggcccgttcctccggcgtatcggccaattttctttgtgataattccagttatctgctcgggatcgataataaaggaaagccggagcgctctgtggagtgttttgaggcggctaaggagaagcatctggaaatcctgaaagaaacgggcggcaaagcagccagagcggtggttctgtattttaaaacctggaagcctgaaaaagccatggaacatactgccctgtcggaggggttggaagagattacggcaggcggaaatttaattttctttatcggggacgagttcgcccaggaagaccccgctgttaaagcagcctgggaaacttacagtcaaaagccaggagacggcgtggaagggacatgcctcgtgaccgggaaacgggcagaaattgcgagaattcatggaacgattaaaggcgtaccgggtgctcagtccagcggggccgcattggtatcatttaatgcgccggcctttgaatcgtatggaaaagagcagagctataatgcgccggtcagcacttatgccgcctatgcgtacacgactgcactaaactatcttttggcggacagagatcatatgaccatgattggtgatacggcgattgtttattggtcggaagatggggaagaggtgtataaccggacattttcctttatgatggagccaacggcagataatcaggagatagtggacggtgtttttaaaaatttggcggcaggtaagaaagtagatgaaaacggtactcaggaaagtctttcattggatcagaaattctatattttgggcctgtctcccaatgcagcaagactgtctgtgcggtttttctatcaggatagctttggaaatattctgcgccatgtgaaagaacattacgatcgtctgcgcattgtgagaccatcaggtgatcatatggagtatctgggggtatggagattattgtctgagactgtgaacaagaagtctaaggataagaaaccggctcccaatatggcgggaagtctgtatcgggcgattatttcggggagcaattacccggaaagcatgcaccaggcggtccttggaagaatacggtcagagcaggatgacagtgacagccgcatttataaaattacgcgaggcagagctgccataattaaggcgtatctgttaaaaaacagaggctgcagcgaggaggaaattactatggaaatgaatgaaaacagcaatgatgttgcgtacatactggggcaggaatttgctgtgctggaagccatacaggaggatgcaaatccggggattaatgcgaccataaaagaccgctatttcaattcagcatgtgcaacaccctcatcaatctttccaattctgtttaaactgaaaaacagccacttgcggaagatgaacaataaaggcagggaaatttattatgaaaaaatgcttggggcccttcaaagcaagataacggaagtgccgaaacggctgaatttagatgctcaggacagatttattctggggtattatcatcagactcagaagagatatgagaaaaaatcaaaggaggaagcgtaagatggcagatgttatcaaaaacaggtatgagtttgtaatcttgtttgatgtggaaaatggaaaccccaatggtgaccctgatgcaggaaatcttcccagaattgatccggaaagtggttatggaatcgtgacggatgtctgtataaaacgtaagatacgcaattacgtggaaacggtgaaggaggacagcgaggggtataaaatatacatcaaagaagatgttccgttaaacagaagcgatagcaccgcttatgattacctggggactgatgataagggcataaaagatttaaagaaaaaagatccggaggtagaccgtaagattcgtgatttcatgtgtcgtaattttttcgatattcgtacgtttggtgcagtgatgacgacctttgtaaaggctgcattaaactgtggacaggttcggggaccagtccagcttggattttccagaagtattgatccgattgtgagtcaggaagtgacaattaccagagttgcaatcactacggaaaaagatgcggaaagtaagagcacggaaatgggacgaaagaatattgtaccatacgcattgtaccggacggagggatatatatcggcgaatctggcgaggaaggttaccggtttctcggaagaagatctggaacttttgtgggaagcaatcatcaatatgtttgagatcgatcattctgccgccagaggtaagatggcagtgcgggagttgatcgtatttaaacacagcaaagaactgggcgactgtccggcatataagctgtttgatgctgtagaagtgaggaagcacgacgatgtggattatcccagaaaatacggcgattatacgatttccattcatgaggaacagattccggaaactgtagaagttataaggaaaatatgatggattacaaggaagaggattatctgatgctttcaggaatccagcatttcgcattttgcaggagacaatgggcactcattcacattgagcagcagtggcaggagaatgagagaactgcagagggggaactgcttcatgagcgcgctcatgatatttgggccaccgagaagagatctgatgtgattatcagccggggattagtggtgcagtccagaacgatggggatttccggggcctgtgatattgtggagtttcgaagaaaggaagatggcgttcctctctatggtcacagagggctgtttgaagtctatccgattgagtataagagaggaaagccgaaagatattcccgtagatgtcttacaacttaccgcacaggccatgtgtttggaggaaatgctttctgcggaaattacagaaggcgccatttattatggtgagatccggcatagagaaaaggtcctgtttaccgaagaactcaggtctaaagtaaggcagtactttcaggaaatgcatcagctttttgataagcagtatactccaaaggtaaggtggtcaaagagctgcaacgcctgttctttgaaagatatctgtatgccgaagctgggaaaaacgccctcagttaaggaatatgtgcatgacaaaattacggaggaggaagcgctttgaaaaaattattaaatacattatatgtgacttccccggacagttatctctctttggatggcgaaaatgtggtgattctggaaaaagaggaggaactggggcgtattcccctgcataatctcgaggcaattgtttgttttggatacagagggatcagtcctgcactgatgggcggctgcgcgatgcgcgatatttcattgtgttttatgacgcctcagggaaaatttctggcaagagtgactggcggtgtcagaggaaatgtcattttaagaaagaagcagtatgaagcgtccgaaaatgcggagttcagcctgggcgtagcaaagaattgtatcctgggaaagatatataatggaaaatgggttctggagcgtgcgaccagggatcatggtttacaggtggatgttgatgcgttgaagcgtgcgtctgcatttatgcagcaatcattaaattatgtttgggaatgtacggacatggctcagcttagggggtatgaaggcgaagccgccagtgtttactttcgtgtatttgatcagttgattttacagcagaaaaaagattttaagttctcggggagaaataaacggccgccgttagataatgtaaatgcgatgctgtcgtttgtatatactctcttaactaatatggtggcttctgcgctggaaacggtggggcttgacccttatgtgggatttatgcatacggaccggccgggaagggtgtcactcgcacttgatctgatagaggaactccgaccggtgctcgcagatcgtttcgtactgggtctgatcaaccgtaaaatggttagtggaaaagatttctcaaagaaggaagacggcgctgtattaatgacagaccgggccaggaagctgttgttgacagagtggcaaaacagaaaaaaggaagtcataacgcatccttatttaggggaaaaggtggagtgggggatgattccttttgtacaggcaatgttgttggcacgatatttaagaggagatttggacgagtatccgccatttttctggaagtaggaggcgtttctctatgctggtgctgatcacctatgatgtaaataccgagaccgctgcgggaaagacgagattgcgtaaggtcgcaaagcaatgcgtaaactatggtaccagggtacaaaattcggtattcgaatgtattgtggataacgcccagtgtgtgatgttaaaagcggcgttgaaggacctgattgatgttcgtgttgacagcttgaggttttattatctgggcaacaaacatgacacgaaggtggaacattttggtgtcgaaaaaggtgtaaatgtagaaaaacctctcattttctagcctgtgaattacggtgcgaaccagaagtgatcataaaatccctgggaggttcgcaccgagaattttgcggttatggaggggaaatgggagaattggatgagttgattcgatgaaatgtgtgcaaattgcatatgattattgctgattgtatggtgtaatatgtgcgagtttgctgtctccgctagcgatggcggagtggattgaaattgaacaaattcgcgaaggacatcgcagtctataacgtctccgctagcgatggcggagtggattgaaataccgacaagagcgtgaacgcttacaacgcctacagtctccgctagcgatggcggagtggattgaaatcctctcgaggacagagacctatgagcagcgctcccgtctccgctagcgatggcggagtggattgaaatatccgaacactcaacaatgtcgacaagcaaatgaggtctccgctagcgatggcggagtggattgaaatataccagcctcaattccgtatagttgacagtaccgtctccgctagcgatggcggagtggattgaaatatctcgacttcaccggtctttaccgctccagatgtctccgctagcgatggcggagtggattgaaattccatgtcggaagtgcgggggctcacaaaatcaaagtctccgctagcgatggcggagtggattgaaatttatcgctgtgctgcaacgttacagttcacagccgtctccgctagcgatggcggagtggattgaaatagtgacgggggagggcggaattactgtagaggacggtctccgctagcgatggcggagtggattgaaatcgaataaatggcgcagtaccggttaacggaaaaagtctccgctagcgatggcggagtggattgaaatctacgcgtagtgtatatacttttaggttagactggtctccgctagcgatggcggagtggattgaaatatcagttccgccttcgtcggagtctctatatgctgtctccgctagcgatggcggagtggattgaaatactgagccaggaggaagcgtttaaacctgcaggagtctccgctagcgatggcggagtggattgaaatctcctcgttttctgtttgttttcctgttccttagtctccgctagcgatggcggagtggattgaaatacgtggctgaaccattcctcccggctcccggcttggtctccgctagcgatggcggagtggattgaaatccatcagccgagagctcctgattgaccttgatacgtctccgctagcgatggcggagtggattgaaatactccatcacctccttatccatatttgatgagccggtctccgctagcgatggcggagtggattgaaatcttgaggacggataccaaagcgtatgggagtttggtctccgctagcgatggcggagtggattgaaatatgttgacttggttaaaactcgtacccgcttcaatgtctccgctagcgatggcggagtggattgaaattccgtaatagccaggcccttgatcaggaactccgtctccgctagcgatggcggagtggattgaaatgtgaccatcagcgccccgtacgttgccatatccgcgtctccgctagcgatggcggagtggattgaaattcccggtccctctggcgtctctggtgctgtgtaggtctccgctagcgatggcggagtggattgaaataatggcagtaacaacacccttaagccatggcgtccgtctccgctagcgatggcggagtggattgaaattggcgtctctggtgctgtgtagacgcttccatcgtgtctccgctagcgatggcggagtggattgaaatcctgcaatcagccggttgcgatccaccgctatgtgtctccgctagcgatggcggagtggattgaaattctctgacgacaaactccagctccgtgcatggctgtctccgctagcgatggcggagtggattgaaatccacttaaataagcaccagccgcagccagtgctcgtctccgctagcgatggcggagtggattgaaatatgtctggcgtgttcttcatcatggtcatatcctgtctccgctagcgatggcggagtggattgaaatttccagaagctgaacgaaaagctttacttttaaaagtctccgctagcgatggcggagtggattgaaatcttctgctccagtttttgaaacaaatcttaatctgtctccgctagcgatggcggagtggattgaaataactttgtataacgttacctttgtagtggcatttggtctccgctagcgatggcggagtggattgaaatcagaatcaatttgcatgtaaatgttgacattatgtctccgctagcgatggcggagtggattgaaatatgtaggagcaaaccttaagaggatacgagaaggtctccgctagcgatggcggagtggattgaaatttgacaacaacagcacgatacgctccagccaaaagtctccgctagcgatggcggagtggattgaaatattttaccatcaaccgcaaaatccccgcgccgatcgtctccgctagcgatggcggagtggattgaaatacagtaatgccatttttagtatcgttgaattgaggtctccgctagcgatggcggagtggattgaaatttaagtgcggtcatggccgcctgaaggggtaaagtctccgctagcgatggcggagtggattgaaattaagaactctgctgtcttcccaaaggcaacgcaggtctccgctagcgatggcggagtggattgaaatcccgaagagagggcttaattttattacatcgacgtctccgctagcgatggcggagtggattgaaattaatgttactggcatacatagtcctccttaattgtctccgctagcgatggcggagtggattgaaattttgaactgctttaactttggaactatgatcttgtctccgctagcgatggcggagtggattgaaattctttggccgccgtgttctccacctggagatccgtctccgctagcgatggcggagtggattgaaatagcattgaccataccctgcacgatagtgtcagcagtctccgctagcgatggcggagtggattgaaattggttactacatgctttgatctttcaaagttgcgtctccgctagcgatggcggagtggattgaaattatcccgaagccggaaggcggcgaggaaatcgcgtctccgctagcgatggcggagtggattgaaatccgtgtaacccctacaatagagcttgccaaagtgtctccgctagcgatggcggagtggattgaaatcaataggcatagccggttttgaatatattcccggcgtctccgctagcgatggcggagtggattgaaatagctggtcctcgatcatcaacgcgaaatgatcggtctccgctagcgatggcggagtggattgaaataatacaaccgcatatccctgttaaattacgcaatcgtctccgctagcgatggcggagtggattgaaatgtacattgatgtgtatctggcagccgaatgggatgtctccgctagcgatggcggagtggattgaaatatgggagaaggaaggtctgaacgtgattgatgcgggtctccgctagcgatggcggagtggattgaaatcgataaagctcatcgagatagtatccggtgacttgtctccgctagcgatggcggagtggattgaaattcctgtcttaaccgttccttttcctgctcttgcgtctccgctagcgatggcggagtggattgaaattgtttttgacccattagtatagtcaacaatgcaaggtctccgctagcgatggcggagtggattgaaatcgtacctgtgtcccgaatcgaatatagctacatatgtctccgctagcgatggcggagtggattgaaatattgttacgatatacaccgcttcttttgctcctttgtctccgctagcgatggcggagtggattttgaggtgcgagtactccatggcatcgtccgatgcctttgtctccgctagcgatggcggagtggattgaaatatcttgaattgactaaaaagaacccgcaaacccgtctccgctagcgatggcggagtggattgaaataaatcttgctggagcagttgggggatttatggagtctccgctagcgatggcggagtggattgaaatcccctcgagattataacctatttagacgcgcccacgtctccgctagcgatggcggagtggattgaaataaaatggcaaaagatagcgctgatattggattttggtctccgctagcgatggcggagtggattgaaatctgtgatgctgttgtaatctcttttttcagttcagtctccgctagcgatggcggagtggattgaaatgtttgaagactaaagttttaacaaaccagtattgtctccgctagcgatggcggagtggattgaaatagtagaaagatataataaagcatcttctgaactacgtctccgctagcgatggcggagtggattgaaatcatctgataatggcggtgacgatgatcttggaggtctccgctagcgatggcggagtggattgaaatgctggattaaaagcgccaatgaaatagccgctggtctccgctagcgatggcggagtggattgaaattttgtatcggcttccatttcctaattggccggctggtctccgctagcgatggcggagtggattgaaatattgatgcccatccccgttatcctccctcctttgtctccgctagcgatggcggagtggattgaaatagaattgaaagagatcaactttgagttatatactgtctccgctagcgatggcggagtggattgaaataaagataagccgtataaatgcttatattatgtggtctccgctagcgatggcggagtggattgaaatcaaaaaggcaagagcataattgaatccgctgctccgtctccgctagcgatggcggagtggattgaaatcgaagggagccactggtgcggcaggagcaaaaggtctccgctagcgatggcggagtggattgaaatattaaaaataaaccagcctctatgccagcatctgatgtctccgctagcgatggcggagtggattgaaatctattttaccaatttagaaaggagttcgtgcatggtctccgctagcgatggcggagtggattgaaatgtgaaggtataaacataggtggattaaagggtagtctccgctagcgatggcggagtggattgaaatagcaggtaagagaacttgctccttgtacattaagtctccgctagcgatggcggagtggattgaaattcaatcgatcaagaaggcgttttttattgctcaggtctccgctagcgatggcggagtggattgaaataaaataatttatatcgcggcctctcctcaccccacgtctccgctagcgatggcggagtggattgaaatatgctggcgcgtcctcctttgaggatcgttgccttgtctccgctagcgatggcggagtggattgaaatatagtcgttaatttggttcggtttgactccaaatggtctccgctagcgatggcggagtggattgaaatctgtataactcttctttttccgatgtcaatcattgtctccgctagcgatggcggagtggattgaaatgttaatagaaaatgtaaaccgatataatacgccctgtctccgctagcgatggcggagtggattgaaatacagggggagcggactatggctattgcaaaatatgtctccgctagcgatggcggagtggattgaaatagctggtcctcgatcgtcagcgcgaaatgatcgggtctccgctagcgatggcggagtggattgaaatcctgatattcagatacaaacctgtcattttttagtctccgctagcgatggcggagtggattgaaatccataatacttcttagctatcccccacagcgtagtctccgctagcgatggcggagtggattgaaatgatttcggtcactacaatcaccccttcaggaccgcgtctccgctagcgatggcggagtggattgaaattaattccggaaaacttattacatctgtgcttagtcgtctccgctagcgatggcggagtggattgaaatcatgattagtgagtgtcgcggcctttgctatgtgtctccgctagcgatggcggagtggattgaaattggtgtgtccggttgggatgggtctgcatgttttgccgtctccgctagcgatggcggagtggattgaaatcatcaccgtcattacaaaattatctgtattaatcgtctccgctagcgatggcagagtggattgaaatcttaagcttctgtgccgctgtcctgccgtccgcgtgtctccgctagcgctggcggagtggattgaaataatatcacccacattaagtgctaccagttccgaaagtctccgctagcgatggcggagtggattgaaattcggagacgttcgatttctttgacggccttcacatgtctccgctagcgatggcggagtggattgaaatactttgaaggagctctggggcatgggcttaacgggtctccgctagcgctggcggagtggattgaaattcgctggtacttaatcatggcatcgttgtattcaggtcttcgccagcaatatcagagtggattgagttacacccgcagccatgaacatctcagttttgtagatgtttccgccagcgctggcagtgtgcatttaaaatcgtaagattattgcaaatatgaaccgttgaggggactacatcagtaatggcagagtgtattagatttacgcaaaaaatcagttctcagacgataaaagtaaataaatagattgaggagagcaaagagtgaagtatatttttatacatggacttggacagggaccagatagttggaataaaacagtttcctgcatgagagaacaggaagagattcaatgtctgaacgtatttgcatttaaagaggaatcagagatttcatataaaagagtatataaggctttttcggcgtactgtgagtctataaaaacggagtttgggctttgtggtctttctttgggcgctgtgattgcgttaaattatgtaatggagcatccgggaaaggtaaagtcactggtcttgatagggggacagtgcgtgatgccgaaggggattttaagattgcagaatatgatatttcagttgatgccgaaggggatttttaagaaaatggggataggtaagagagaactgattcagttgacaaaatctatgatggcattggatttcaaagaagatttggataaagtggattgcaggacgctgatcgtttgcggggagaaggaccgggcaaacagaggggcgtctgaaatgatggcagagaagattcatggggcgagaataaagatattggaaggctgcgggcacgaagtgaatgtagaggcgccggaaaagctggctgaaattcttgaggcgttttacgaagaaaagtaggatgggaacctgacaggaaccgtggtgtatgaacaacaacgagcaggtggtgtatgaccgtggtatactgacatccgggagcataaaaagtcaggatgaatctgcgatgacaggatagaatagggctatacggaaggagatgagaggatgaactggatcagcggcttgcagaaggcgatcgactatattgagagtcatctgacagaagaactggaggcggcggatattgcggcacaggcaaattattcaccgtaccattttcagcgggtatttgggattttgtgcggatactctctgggggaatatatcaggatgaggcggctcacacttgccggcagtgaacttgcgtctactgatataaaggtgattgatgcggctcttaagtatggctatgattcgccggagagttttggaagagcattttcgcgttttcatgggataacgccagtacaggcgaagtcgggcagagcaaagttaaaatccttttcacgcctttccgtaaaacttattttagatggaggcagtaccatgaagtacagaattgaaaagatgggtgagttagaggttattgtaaaaaagaaaaatttctcctgtgatttggagaccagcaacaggcaactgccagagttttggggagagtgctggacagataagactatgcttgagctgtttgaacggaatccgaaggaagggatctttggagatgcactgcttgggctttgcctgagtgaaattccgcaagcgaacgaatttgtctatgcgatcggcatgatgtatgatggaggaccggttgcggaagaattaagcgtggagaagattccggctcacacctgggcggtctttgaatgtgtcggtcctattcccgaggcttttcagaaaatgcagcatacggtctattccgaattcttccccagcagcgaataccagcccagcagcggacttgatattcaggtttatccgacgggagatatgcagtcggataagtatgtgtgccagctatggattccaattgagaagaatttatagaacggctgtaatgttggtaaacagtggaagcaaacggaaatcaggagaaaaacaggatgattcatctcagcaaagaagaattgacagagacgctttttgtgattgcctcgattgtggggaggtgcgagaatgcacagactaaattcagagaaggcacctctcagcatacgcttttgaaaaacagaattagggcgctttatctctcaaaggaactggttgaaacagaacttttgcgaatgggggagcgactgtccgcggtgagttgtgaagagactaggaaatgcgaagagacggggaaatacgaagtgacggggaaatacgaagcactggacaattgcgaaatactgggagaaggctttttaatggaggaactgaaatcaacggttcctccaattgtttccataatcagtaaatgtgagaaggcgcaatcgaaatacgagaaggggacggcacagtttaggcggtacgaaaagataatccatgccatgaaggtctcaaagactttattggaggaccggctggagacttcagccgagcgaaagtaaaaaatttacaggttttataaaattatctccgttgaagattgtccctcctcttacttataatagacttatcaggcagtaagaagttttgacataagatagctatgaaagctggagcgtgtttgaaaattcatatccgccatctgcgcgccactgcgcggcatatttggccccaacttagacagcgtagcccactacgtttccttcatggggaacaaatctcccacaaagtgtgacgcacagctgacgataagaaattttcaaacacgctccagggtaaggggacaagcaacagatcaagaggacaaacgagagggaggttttacaatgaagaagagatggattactctgacgctgacggcggccgttatggcgggactctgcggctgtgcggggaacagcggcacttccggagcaggagacacggccggagcgaaaacggaggcggagacgactaccgcaaaagcagagaccgtggcacagacagccaaagaggagcagaaggacgagataacgctgcagttctgggagatgaactatggtagcgatgacgcctacttagagacctgcgaaaaactgattgcacagtatgagagcgagaatccgggcgtgaatatcgaggttacggtacagccgtgggataattattaccagctgtttttaaccgcggtcagctctaatgcggcgccggacgtggccagtgtggctctggatcttccggatatgtacgccagaatgggcgaggctctggaacttaatgacgtagtggcggagtggaaacaggatggaaccattgatgactatggggaagccacaatgaaatcatttacttacgacggcgatcagatcgcagttccttatatggtgggatacagaggaatcttttaccgcagcgattatttaaaggagtgcggaatcgaaaaggttccggagacctgggatgagctgctggcggcgtgtgagaagatcaaagaggttcgcccggatctgactcctctggatttcgcgggagccgacatgggactgtggcactatttcatgtgcttcgccatgagcaatgacgctggaatcgtgaaggaggatggtacgccgggaagtacggatgacagatataaggcggccatcgatctgtttaaaacattcaaggaaaaaggctatgtggctgatggtgtcctggggcataaatcggcggatgcggagaaactgtattacagcggcaagtccgtgttctggtttaccagcttcccggcttccatctttgattatccggagattctggaaaataccgaggtttacagcgcatttaagggaccggacggaaccgcggtcagaacctccagctttagtgacgctctgatggcattctcacagacaaagcacccggaggaagcgaagaagtttgtaaaatggtgggcagagaacagcagcgctttatataccgaaggcggatgctgggcgtatccggcgaagaaatccttcttcagcggtgagacctttaacaacaaggttgcccagggcgtgttaaataagatcgtgccgaccgcagtaccgtgtacctggccgatcgagaatattttcccgggattctctcaggtaaatggagagcagacgatgaattacagcgcacaggaggcgcttaacggtaaggtggataccgacgagatcgccagaattcaggcagaaaagatccaggaagcaatcgacatcgcaacagaagagtagtgaccagagaggtccggcttttataaaaggccggaccttcattaaaaaaggagggactgctgatggagaaaaaccggagaaggtttggccttaaaatgctggtcatgccgacgatcattctgttgctggtcagcttttatccgctgtttaacagcatttatttaagtgttaccaatacgaatattttaaagaaaggacagacggtccggtttacgggcgctgccaattttatcaagctgttttcggacaggaccatggggccgtccctggtgtattccctggagtatgcgtttatctgtgtggccgccagctacgtgctgggactctttctggccgttctgctgaatcagaagattaagggaagagcgctgtttcgcggtctgattctgattccatgggcgataccgaccgtagtggctacggcgaactggctgtggatcttaaatgaccagtcgggaatcgtgaacgtgattctgcagagactgcatctgacggatgggccgattctgttctttgcggatcagaggatggcgcggatcacatgcatcgtggtgggaacgtggaaatcgtatccgtttatgtgtatgtcgctgctggccgggctccagggcgttccggaggatgtctacgaatcggccaggatggacggggccacgggaatcaagacatttttctatattacactgccgatgatccggaacgtgagcatggtggtcgtgactctgatgttcatctggggctttaacaattttgatattatctatcttctgacgcagggcgggccgctggaggcgacctttacgcttccgatctatacatataataccgcgttctaccggggacagatggggtatgcatccgccatttccatgatgactcttgtgattcttctgttcttctgcgcagtttacatgaaaatgcagaagggaaaggatgacgtatgaaaaataaaaaggggatcatctatgcgcttctgatctttttctgcgcggccgccaatttaccggttctgtccatgattggaaccgcgctaaaaccgaggtccgagacgctgtcaaccgtctcgctgttcacgctgcatcccacgctggataattttatccatgtgcttaccaggacctcttttgcacagtctctcgtcaacacgatcttcgtggcgctgatcgtgacggcgctgtgtgtggcattttctacgatggccggtttcggactgtcacggtgccgcggcgtgctttttgacgggtatacaatgtttctcattatccttcagatgctgccggccatgctgattatgattccgctgtatgtgactctcagccggtttcatctggtggatacccatttcagccttatcctcatctatacggccatcaatctgccgttcggtatctggaccctgaaagggtttttcgatgatattccgacggagctggatgaggccgccatgatcgacggctgcagccgctttcaggcgtattggaggatcatcctcccattttctctgcctggagtggcatcggtgggagtgtttactctgatgaatgtgtggaatgagtatacgatcgccagtatttttatccaggataagaatctgcggacactgtcagtgggaatccggcagtttatgatgcagaatacgacagactgggcttccatgagcgcggcggcaaccatcgcggttcttccggcgttcgtcatgattatatttgcacagaagtatttggtgggcggattgacttccggttccgtgaaaggatgagtagatgagagaaagtgtactgattttgtgccgcaatgaacgggaaacgatcctctacgcggcggaggaactaaaacgttacttaagcctggccggcgtgtccgcctggacctcggtgcgggagacgcacagcccgtatataaagatactggagctggcggtgacaccggaagagttttggggaaaggaagggcagtgtctggagcgttctcctcattccagccagcgggatacagcggaaagtccctcacactccgttcggcggtatgtagacgcctacgccatcacagtaacggatctcgggggatccataaaggggtccaataaccgcagcgtgctgctgggggcctaccggtatttaaaagagctgggctttgcatttctgaggccggaccgggagggggaacggattccggcatcggtggggccccacacggtaaatatcagggaggaggcttccagccggtaccgcggaatctgtatagaaggcgccgtgtcatttgaaaatattatgcgctttgtgacctggcttccgaaggcgggctttaacacgtatttcacacagtttaagattccctatgagtttttcaagacgtggtacctccataccaataatccatattacgagaaggaaccggttccctcggaagaagaggtggacgcatttgtgaaagaaattcttgtgccccatataaagaagctggggctgatctggcaggcgggaggccacggctttacgacgggagcggcggggctgcccggtacgggatgggatcctatggcggagaagaaggtgccggaggagcgcagggagtatctggcgatgatagacgggaagagggggctgtttcatggcgttcccctgaacaccagcctatgctgctccaacccgctggtgagagaattgctggttcaggagatccttcattacattcacgggaaccctcggctggacatggtccatgtgtggcttgccgatgacggaaacaatagctgtgaatgcggggcgtgcgccgcgaaacggccttccgactggtatattgagattttaaatcaggtggatgaggtgctttcaaaggagggcagtcccgtaaaggtagtatttctggcatattatgatctgttgtggccgcctgtcagcgcgaagcttctaaatccggagcgatttgtgttcatgtttgcgccgattacccggtcctaccggacgcctcttccggtggaagagacgccgctgattccgccttataaacggaatcagtgcagatttccggtaaatgcgggggaaaatatgcattactgcagcgcctggaagcagttttttcggggggacagctttctgtatgattatcactatatgtggaatcagttccgggactggggagattacggatcggcggaaattctgtggaaggacctggtgaacctggaagaggcgggctttgacgggtatgtgagctgccagcagaccagggtatttgcgcctacgggctttggaatgtatgtgatggctgaaacgctctggaacaggagctgtacctttgaaatgctggcgcggaagtatttccgcatggtctacggtgatcaggcggaggtggtgctttcctactgtaaggagctctctgcactgtcgtatatggagcagccggagaacgatgatccgggagtgtgcgcggaggctgtggaaaagctgaaagcggcggccgatttaatcagaacttaccggcctctttttgaaaagaattttggggatgagaagatacaggaccggatggcatggaaatatctgttatattccggcagggctgccgaaatgtacataagtatgctaaaatacaggagactgggagcagaggatcgggtttcggaggaataccggaagctgaaagagtatctgtgccggacggaggaagaatggcaggaaggctttgacgtctactggtttgtgaaggacagagacaaaaagttcctggcctctgatacgtaagaaaagggagggatcgtgcttgggggataggagaaagcgaattcccgcgcttctcagaagaattggcttgaagagaaggctgtttatcggttttgtgatcgtttcacttctgccgatggcggtgctgggggtcatcatgggcgtcaggctttaccatacgattatggacaattacgaggaacagtccatacaggcgctggggacgatccagtaccggatcggaatcgtgaccggagccaaggaggagagaatcaatgcgtttgcctctgacgctgatgtggtcaagagcgtgcgcaagctgaatatggatatcagccttctcgaccggactgctctgacgagagatctgcagggcaagctgctggccgaattaagccagattaagggcggtgtgcgtgcggaaatcctggacaggaacggggagttcgttacagggatcttcgacgaccgctacacggcgctctccggcgaggcgagagcccgggcgaaggagagtccggaccggctgcatctgtggcacggaacggagcaggagggggaagagattatcgttttctccaggcagattattaattatttcaatggaaggaccacgggatgggtgcttctctatgtggggacggatgaactgaaggaagagatgaagacggtgcagaccgatgcggttatcgccgtttacgatgaggatggcggtctgatctgttccggagcgggaaatgggagtattgccgatattgcggatggagatttaaatgaggctggattccgggtatcgggctaccgggattccgaggatatgtggaaggcagactggaagctggaatcgggcaggtatcaggtgcttttccagaatatggccggtaccggatgggagattgccatttttaaggattaccatgaactggtccggtcatttgccggaatcgggattctggctgccgttatctgtctggtgagcatcggcatcattatctgcctgtcgcttttgatcaccaggaccgtggcggaaccggtacagaacatcgcggagagcatgaagatcttcagccagggaaacctaagcgtcagggtgacggacgacgcggcggatgagatcgggatgctgggaaatgaattcaattccatgagcaataacatcgagcgtctgactcacgaggtatatgaggcccgcatcaaggagaaggaggcgggcctaagagccctcgaggcgcagatcaatccccatttcctgtacaatactctcgatatgattaactggatgtcataccgctcatccaatcaggatatctgtaagattgtgaagtcactttccgacttttttaagctgagcttaaaccatgggaaggagctttacacagtgggtgacgaggttcgccacatacagagctatgtcaccattgaacagtataagaaggcggaaattgattttgagattcatgtggacgaggaattgaagccgtgcatctgcccgaagctgatcgtacagccgctggtggaaaacgccatccttcacgggatcgagccgaaacggggtccgggaacgatcatcatttcctttgtccgccgggaaaatgacatcgtgatcacggtagaagacgacggcgtggggctgtgccggaagcagagagaaggcgcccgatatcaccacggcggatatgggctgcagaatatcaatgaacggctcaccatgctttacggaaagaagtattatgtgactgtggaagagagaatgggaggcggcgtgatttccagtgtcgtcattcccctgatcggattggaaggtttggacgatgtatctgatgattgtagaggatgaaaaatttattcgtgacggtattctgtatctcttgtccgaggtaccgggcattacggaaatcgacacggcctgtgacggggaggatgcctggagtatgataacggatgcaaggcggtttcccgatatcgttctgactgatatccgtatgcctggtatggatgggctggagctgagcgataagatccgggagcattccgccgcctccaagatcatatttatcagtggatatgaggattttgcctatgcgaaaaaggccatttcccttggagccagcgggtatgtgacgaagccggtcgcccaggatgagctgctggagctgattaaccgcgtaatgatacagatcagaaaggaagagcagttcgacaggcagcaggagatatcgtgttttcatgagaagcagtcggatgcgctgctgggagatatcttaagccagataagggataacccgggcggcgtgtccttgaaggcgctgtcggagagctggggcgtgtccctatcctatatcagcattctattcaaggataagaccggccataactttaaggattatctgctggactgcagaatgaagagggcgaaggagcttttggcggcgggaagccaggcggctgagatctgcgagaacttaggatacagcgattacgattatttcagcaaaagctataagaagtattatggcgagtcgccggcggaataccggagaaggattcatttataggttacgttttccgtgcctctgcgaagataaccgcaggggcatttaaacttgcaacagacagacatgttgtgctataatggggaaagctaaatacattggaggtattacaacatgaaaaagattattttgacgggggaccggccaacgggtaaacttcatatcggccattatgtgggctccttaaaacgcagggtggagctgcagaattccggtgagtttgatgagatatttatcatgatcgccgacgcgcaggctttgactgataatgcggacaacccggagaaggtgcgtcagaatattattgaggtggctctggattatctgtcctgcggccttgaccctgcaaaatcgactctgtttatccagtcacagattccggaactgacggagctgtccttttattatatgaatctggttaccgttgccaggcttcagagaaacccgactgtgaagtcggagatcgccatgaggaattttgaagccagcatcccggtaggcttttttacgtatcccatcagccaggcggcggatatcacggcatttaaggcgactaccgtgccggtaggcgaggaccaggagccgatgatcgaacagacgagagagatcgtcagaaagtttaactctgtctatggggacgctctggtggagccggagattctgcttcctgacaaccaggcctgcttaagacttccgggaaccgacggaaaggcgaagatgagcaagtctctgggcaactgcatctatttatccgataccgaggccgatgtgaagaagaaggtcatgagcatgtacaccgatccgaaccacattcaggtttccgatccgggacagatcgagggcaatacggtctttacgtatctggatgctttctgtaaggcagatgcgtttgagaagtatcttccggattacaagaatctggatgaactgaaggatcactacaaacgcggcggactgggcgacgtaaaggtgaagaagttcttaaacagcgttcttcaggaggagctggccccgatccgtgccagaagaaaagagtacgaggccaacattccttatgtctatcagatcttaaaggaaggcagcgagaaggcggagcgtgtggcggcggatacgctggccggcgtgaaaagagccatgaagatcaactattttgatgatatggaactgattgccgcacaggcggagaagtataagaatcaggagtcataatgtgggaagaagttcaaccgttttataaaatgcggcagcgtttttataaggcggttgaattattttaggagagaaaggaagtaagacaatgaaaaatgtgatatcgcttcgtgaggtagtggactgtgatgcgtttttgaaggaaaagtgcttaaatttcaggattcatctgcgggatgcgtgcggaaaacagtcctgttggattgagcctttgagtgagtgcggatgtgacggccagtacgaggagctgtatgcggctttggaggaattctttggaaaactgcgttacaagctggagtacagcgacgataagcttaatttctggctttccaatgaataggagcagcaggccatgaaatcgcgttataaaggaattgtgtttatcgtatgctcggcgttctgcttcgcgctgatgaatctgtttgtcaggctgtcgggagatctgccgtccattcagaaaagttttttccggaatctggtggcatttttctttgcactcattctgatgaaacgggatcacgtgggcttttccggtaaaaaggagaatctgtggcagctgattctgcgttccacgttcggtaccatcggaattctctgtaatttttatgcggtggatcatctggtgctggcagacgcctccatgcttaataagatgtcgccgttttttgcgattctgttcagctttctgattttaaaggaaaaggtaaagccggctcaggcagtcatcgtggcgggcgcatttgccggaagcctctttatcatcaagccgtctcctctcaacatggagcttgtaccggctctgatcgggctgctgggaggcatgagtgcgggagccgcctatacctttgtgcggtcgctggggatccgtggggagaaggggccgtttatcgtctgtttcttctccggattctcctgtctggtgacgcttccctaccttctggtgcggttccatgggatgacgtgggcacagctgggatttctgctgctggcaggccttgcggcggcgggcggccagtttgcgattaccgcggcgtactgtcatgccccggccagggagatctcggtctacgattattcccagatcatcttttccgccgtactgggctttgttatattcggccaggtaccggaccggttcagcgtgctggggtatgtgatgatctgcgcgatggcggtggtgatgtttctttataacaacagacggacgcaggcacacacctgacgcagatatcaagcactattactcagttatttatgcaacgctgtactagaggagagttctgcggtacagtaactggatctgtggtcactgaccgaatatctcagtgaccatggatctggcgaaatcctcgagcagttcgattcctccatcggctgaaaatggctctgtactgccatagctttcttccgcattgctatagctatcttcggcactgcgaatgagggaagcgtacctggacggaagattcttcagtccccagtgcgccccctgctgtttggagaggatggccccctctttgctataggcgcatacacggcaaagattcaggatgaggtaaaccggattttccccaatctcttccaccgcgtttttaacgtcacttttcaggctgtccaggtaatctgctttagggacatctccaaagagcgtatccgccgtttctccgtaaagggtgatgccggccttcctgattatggtgaaatgcgcggccagatcctgatcggtaccgttcatgcgggcgcagtatccgcttacatcatcacagcacgattgcttgtgcgcgttagaaaagtgaagctcaaactgggttgggtaagtgaaattacggcagtatttttcaagtacgatactcatttccaggccctttggagggctgatccggtcgatttttaacaagtctttgatcagtttttctttttccatctgtgtcggcgccgtccgcgtcacgacaataaagtcaatatcgctcttatcccagttgaaacagcctaacgccagcgaaccatgaagatagatcccggttaaattcgcggataagatattggtgcaggctgctttgagctgctccagtattttttctacacgcatttccataatgaataattcctttttctttcataattgatgtgttttgggtgactttttcttatactgtaaggcggaaagcggaggctgtcaagttgttctccgcaattgatccggcgggagaaaggcctgcccgttttgagcaaaaggatagaattgcccgccgatgtgccatgagctttggaatatcctttatccctatgtgttcgcactgcagaatggggcggaattggattatggtgctgttcatgcaaggcaattcgatgcgaagtgcccggatggcggaagagtgtgcgttcatggagaggtagtggagtaaggctgtgtaggtagctcatcattgattttttacaatagaaaatatatccaaatttcagtatgataaaatgataataataatcaatactgattattgactttcccaatccctggatgctataatgttcctataagttagatgtgactaacttataatttccctataaatgaaccatattacttatggataaattggcagaaaggagacataaaaattatgtcattaattggaaaagaaatcggagagtttaaagtacagagttttgtaaataatgaatttaaagaggtaacgaaggaggatgtgctgggaaaatgggctgtatttttcttctatcctgcggactttacctttgtgtgcccgacggagcttgaggacctggcggacaagtatgaggacttcaagaagatcggatgcgagatttacagcgtctcctgcgatactcatttcgtgcataaggcatggcatgacgtatcgaagaccattaagaagattcagtatccgatgctggcggatccgaccggcacactggcccgcgactttgatgtgatgatcgaagcggatggtctggcggagcgcggttcctttattgtcaatccggaaggcaggatcgtggcctatgaagtgatcgccggaaatgtgggcagaaatgccgatgagctcttccgcagagtacaggcttcccagttcgtggcggagcatggcgacgaggtttgcccggctaaatggaaaccgggtgctgagacgttaaagccaagcctgaacctggttgggcttctgtaatatgactgggcagtatgacgtcatcgtcgtgggagcggggccggccggattatcggccgccctctacgcggcgagggcaaaataccgggtcctcgtcctggaaaaggagaaaatgggaggacagattaccattacatcggagatcgtcaattatcccggcgtggagaagacgaacggcaccgagctgacggaacagatgagaagacaggcggaagcctttggcgcggaatttgccatggcggaggttaaggggatcgatctggccggggagatcaagacggtgaagactgacaagggagagtaccaggctcccggcatcgttctggcggtgggagccaatcccagaaagctgggctttgcgggcgaacgggaatatcaggggcgcggcgttgcctactgtgctacctgtgacggtgaattttttacgggaatggatgtcttcgtcatcggcggaggatttgcggcggcggaagaggctgtattcctgacgaagtacgcgagaaaggttacgatcatcgtccgtgaggaggatttcacctgtgcgaaggccgtagcggacaaggcgaaaaatcatgagaagatcgaggtacactacgaaacggagattttagaggcggctggagacggactgcttcggcgcgctcgttttaaggacaacgcatccgggaaggagtggagctacgaagcaccggaaggaacctccttcgggatttttgtatttgccggatacgtcccggatacgaaatggctgaagggtctggtggagctggatggacagggctatatcatcaccgaccgggaccagaagacgagtgtggatggcgtctacgcggccggggatgtctgcgtaaagaatttgcgtcaggtggtgaccgctgtctcggatggagccgtggctgcgacttccctggaacggtacgtttcggagacatacgaaaaaccggagctggccgtatggaaagcggatatagaagaaaagcggacaaagaatgtggaacacgcctctgtttctgacttaaacgatggtgtattgattaccggggagatgaaatcccagcttgcggacttattttccggacttcagaatagaatagtcgttgagggtgtcctcgacggcagtcccatggcggatgaaatggagcagtttcttgaagaactcggcgatatttcggatatggtggaatgcagatcccgccgtgaatcggataagggcaaagaggatgaagagtatccggtgctccgcatcttaaaggagaacggagatgagaccgggattcgcttctatgcggttccgggcggccatgagttcaattcttttgttctcgcaatctataacgcggccgggccggggcagccgattacggacgaagagagaacccggatcgggaagctgaagggaccagtgaatataaagattgcggtctccctgtcctgtaccatgtgtccggccacggttatggcggcgggcagaatcgccgcggaacatgatggtgtggaggcgtgggccttcgatctggcccattatccggagatgaaagaaaagtatcagattatgagtgtgccgtgtacgatcatcaatgacaggaaggtggtattcggcagaaaaacagtggatgatctgctgacggttctggaggaatcctaaaaggaacgggcagatgaaaggagaatgaatatggactatctggaaatagaaaaggttatcggacgggaaatcattgactcaaggggaaatccgaccgtggaggcagaggtatggctcgctgacggaaccatcggaagaggcgcggcgccgagcggtgcgtctaccggtgaatttgaggctctggagctgagagataaagataagaaacgttttggcggaaaaggcgtcaggaaggctgtcgaaaatatcaatacggtcatatccggtgtcctgacaggcatggatgcgtcggatatttacgcggtcgatcacgccatgatccaggcggacggaacgaaggacaaatcaaagctgggcgccaacagcattctggcggtctccatcgcctgcgcgcgggccgcgtccatatccatgggaatcccgttataccgttttctgggcggaatctcaggaaacaggcttccggtgccgatgatgaatatcttaaacggcggcgctcatgcggcgaataccgttgatgtacaggaattcatgattatgccggtcggcgctcccacattccgtgagggactccgctggtgtaccgaggtattccactgtctggcgtctattttaaaagagaaaggcctggctacctctgtcggtgacgagggtggcttcgctccggacttaggaagcgacgaggaagccatcgagctgatcttagaggcggtaaaacgcgccggatatgaaccgggacacgatttcgttctggctatggatgcggcttccagtgagtggaagagcggaaaaaagggcgagtacctgcttccgaaatgcaagaagcattttacttcagaggaactgatcggacactggaaacagctttgtgagaagtacccgatctggtccatcgaggacgctctcgacgaggaggactgggaaggctggaagaagctgacggcctctctgggcagcaaagtacagctggtcggcgacgaccttttcgtaacaaatacagagagactgaagaagggaatcgattccggatgcggcaattccattctgatcaagttaaatcagatcggctccgtgtcggagacgttagaggccatcaagatggctcataaggccggatatacggcgatcgcttcccatcgttcgggtgagacggaggacacgaccattgcagaccttgcggtggctcttaatacgtgccagattaagacaggcgcgcccagcagaagtgagcgtgtggcgaagtataaccagcttctcagaattgaggaagagctgggcgagacggctgtttaccctggaagaaatgcattctgcatcaaacggtaaaatgcggccagtaaattaagaaaataaagagaacggctgacagaagacatctcctggttcctataaaacggaatggaagaggcggcttctgcctgccgttctttttatggatcgtcctgatgaatgcggctgagtgaaggctgcatctgcatttcaatgtgacatttgccgcagactatggtaaaatgaaaggaaaattggttgaaatacagaagttggaggcactatggtctggatttatcacgctttttttgaaccggggacagggggcaataagagagagactgagcatgagcagggacttttgctcctgcagagagccttaagggagcagtatgggattgactgtggagatggccggaagccggatctgattgagggagcacacggaaagccatacttaagggagtatccgcagattcagttcaatatcagccactgtatgggactggccgtgcttgccgtcggggattgctccgtgggaatcgacgtggaatatgtgcggccgtaccgggagccgcttttaaagagagtgctttctgaggcggagctccgacagatggaggcagcgggtgaagccgggcgggaggagctgttcttccggttctggactctgaaggaaagctgcgtgaaagcgatgggatgcggtattactgtgcctctgcaggacatttcctttcaaattggtgatgacgggggaattacatgtgaaaagaccggttggaagttccatcagtggattctgacaggggggtatgtgttatcggcctgtgtatcgggggaaggggaaattcgtctggcagaacaggaggaacggccttgaacggtgagaaaaaggacttgcgttacagcagaacggacaggctcctgcaggaggcatttttagagcttttgaaggtcaaatccgtcgaccggattacgatcagggatttgacggaacgggcggggatcaaccgctgtacgttctaccaccattaccaggatatctatgatctgctggaacagatcgaggatggggtcatggagcacgtgctggaaatgatgcggggcttccatccgaaccgggaagaggatgtcagccgccgttattttgagtgtttctgtcagtatatctatgaaaaccggaccgtatactgcgtgctgaccaatggccaggaaagccggtttatcaaaaagctcctgaggatgatctcggaatacatggcgggattatccggtaaggagaatgacggcgacaagctgagccgtgagtacgcggttgcctattccatcggaggtgtggtgggcgtcctgcataagtggatgaaagaggattttgaaagccctcccgaggtggtggccggatttatcagcagcgtatttctaaatgggatgaaggatattctgtgagaatagtaatagaagtcagaaaagaagcggtttcgggtatgatactcccgaaaccgcttctttcaagtatctgcatttactcatacgctgcagaagcgtttgccttttgtgacacggcgtaatgttcgatatagtgcagtgcgtctcctaccgttgtaatctcgagtaaatcactgatgtccatctcaatctgaaagtgctcttcgatgtctccgatcatcgctataaaatccagagagtcaaattctaagtcttcaacgaagcgggaatctctggtgatggattccgggctgacatccacatactgggtgacgagttcctttaactgcttatacatattcattcctccctgattcgccgccggaaactgtccgatggtttgaatttgagtccaagtttaagcagatttccttcaaatatcaagcaacagattggagaaactgttgcttaaacaacagatttgggaaagtgttgcatattgtctcctcagaaaatgatcctgacgtagagtaaagagtctgacgagccggactctcgcgctgaagtgcagctgcttcagctgccatacttccttagcgcggagcactttcctattacacaaaaaagggaaccgtctgttccggttcccctgtgttttattcctgttgactgagtacctctgcgttgatgcccataattttcagatatccatcttccgctaaggaaaagaagagaccgggcgatccggattcgctgcctacgaagatgcctgcctgtgacggtgtcagacgatcgggatcgacaccggcgaccgcctgaagcatggcgtctgtaaaaatgtcgtccttctgggccttcagaccggcggcatctgcgacatccagcccctccgtgttggcttctgtcgtcacgtaaacgggataggcgcagagccgggccagcgcttcgatatcgcgctccgagaaaatatgctgaatctgttcggcaaagcctttatagtccgattcttccagggacgcagcccggctgccggggacttcggcattcgcttctgcttggcgggggctgtcggagtctgcgctgttggcgttatcgccgccggagccgctgctgccggagctgccgctgctggaactgccgctgtcggagctgccgctgctggaactgccgctgtcggaactgccgctgccggaactgtcgctgctggaactgccgccgccagactctccggacctctcctcggactgattctccgcagacatgcgctgagtcatcagctgtatcttttcggcggaagcgctgccgtttccggccttcttcacttccgactcccttagatcgatcgtcacctcatctccggccagcagatcccccagtttcatctccgtcagttcttctgtgccgaggccgtaatagtataactgggcgtgggagcagtcgataaagcagcgttccccgaacagggaatcgccgcttgcgccgccattatccgcatcctttacgtaaagtccgttccggtcttcatcggtttccagaacaatggcattattgccgagatagagcgggtcttctttaggctggcagcccgtcaggcacagcagggccgcggcggccgcagcggcagtcagtaagcggatatttatcatggggcagattctcctttgtaatgacaggtttgatcaatttatctgatccgttaccttcattttaaggtctgtccataccgatgtcaaccgaaggttttcgggaggactgttttaatgggaaccggctctctgagatcatgagcccagccagtgtcagcacgattccgcatacggactgccaggtgataacctcatgcaggaagattaaggacgtgatcaccgtaatcaccggaaccgcgtaaatgtagacactcgtctttacggagcccagagcccgtaccgcgaagttccaggtgacaaagcagagcgcggaagcgccgaatcccaggaagagaatattgagcgcgttctgcatcagcatgaaacgagccggagcgatccggaaaggcaggaagaacagcgccggtaccatgaagaggaggccgtagaaaaaggttctgcgggtgctctcgatggttccgtacccatagcttccgatctttttcgtgagtatggagtaggccgcccaggtgatggccgccgccagggccaggaaatctcctttggggcttagctgtacgccggtatccttctggaagcttaagagggagattccaagcatggccgccgcgaagccggttaagaaacggcgcccgggcttttctcccttcatgaacagccagtcgaagaggctggtgaagaacggggccacggagatgataatgctcacgttggctgcctgggtcagggtcagtgcgaagttttccatgaggaaatagagggtgacgccgcagaggccggccgctgcgaagagcagctccgcttttctgtctccggtatggaggaggcggggggctgcgatccacagcgctgcgtacccgataaaaaagcggaaaaacaggatttccagcggtgtaaaggataccagcagaaccttggttgagataaaggtggttccccagatgaagatggtgacggcggccgcaagatggcccgtcatgttagacttttctgacatttgtttattcctccgtgccggcggtggtgtccctgccggattctgtaaatattttctgatactgcttcggagtcagccctgtgaaatccttaaaaaaacgggtgaaatgactctggtcggtgaaaccggccctggcggccgcgtcgatgggaggtaccgcctgctctaacagcttcttcgcctcttctaagcggatggactggagatagcggtacggggatactcccgtctgctttgtaaaggtatggagcagccacgatttgctcagatgaatctgttcggtcagctcttccagcgtgatattttcggaatagtgttcctttagatattcacacgtatcggcgatggcgctgtccaaaaagactccgttatgctcttcgtaaggagcgctgtgctccttaaggatctgctccagcaggaaaaagaatgcttcctctttttcaaagggggacgcgtcggttacaatggcattgtagacatcggccagcgatgtggtgatatcgctgtgatagactacatttacggtgaattgtgggacaaattcttttcccgtgatgtcggcggccgcttttttcatgacaggcacgggtatgtttaacgccctgtagtccagcagctctccgttcatgggagaacagaagtgattgtctttgggattaaagaggatcaaatcccccctcgacagatcgtactcggatccgcggcaccacagatggcggcagccgccttctataaagccgatgacgtagcattcgtgaaaatgattggggaatttctgtacgatgccgctcagctggtatgcctcgataccgagacagctgtcgtagaatatatggcgttgttcctgtgatgttgtcatggcgtgctcctttcaaacttttttgattttatcacaataaagtaaaaaagtcttgtatgatgttgcaaatctagtactgcgctgcataaattccttaactttacaggtttacttatgaaatcctgaaaaactggaaagaattcattagaaagagagtgacaaaagattgaaaatttgagagtaaacggtaatatggaggaactgcacatgaagaccatgacagataattttatgatttcttttttacagcgatttgacgagcacccgtttgatgtgaagatccatgggaaaacccatcatatcggaaatggaaatccgacctttgtggtggatttaaaagaggatatcgaggggaaagagcttttgacgagcacctccctggcgctgggcgaggcttatatgaagggaaatttagaggtggagggggatttgttcgaggctctggactcatttttgggacagatggaccgattttccacagaccggtccaaattaaagaagctgatgtttacatcccagtcaaagaagaatcaggagaaggaagtcacctcccattatgacatcggcaatgatttttacagcctgtggctggatgagaccatgagctattcctgcggttactttaaacatgagaccgacaccttatatgaggcgcagtgcaataaagtggagcgtatcctggaaaaactctgtttaaagaaggacataaccctgctcgatatcggatgcggctgggggtatctgctgatccgggctgcgaaggagtacggtgtaaaggggcttggaatcaccttaagccacgaacagcagaaggaattcgaagagcggatcgaaaaagagggattgacgggacagattgaggtagcgcggatggattaccgcgagctggagaagagcggcagacagttcgaccgggtggtcagcgtcgggatgctggagcacgtagggcgggcaaattacgagctgttcgtaaaaaatgtggattccgtgttaaagccgggcgggctccttctgcttcattatatcagcgcgctcaaagagtatccgggggacccgtggatcaagaaatatatctttccgggcggcatggtgccgagccttcgggaaataatccatttattcggcgactaccggttctacaccctggatgtggaaagcttaagacgccactactataagaccctgcgctgctgggaacaaaacttcagcggccacaggcaggaggtggaggagaagatggggactgagtttgcgagaatgtgggaactctatttaagctcctgtgccgcgaccttccacaacggtatcatcgaccttcatcagatccttgtctccaagggcgtaaataacgagctgcccatgacgagatggtattaactggaaatgaggaattctctcaaaaaaagtggttgcatttttagttagcatatgctaatatatattcagttagcaaacactaactacatgtgaatattctatacattaaccctctgggttttccttcattgacccgtgaaggaatcatgactcctatgagaaccgcctctgttaccgcatgacagaggcggtttttcatgtcatagtaaaagggggatgcgtactccgtgctaaggaaacatggccgctttagcgaccgcgctccggcgcgccagtccggattaccggactctttattctgtcccgcaatgatttttgcaggcagcggagtatttgaatcttgtgtattgatatgcagaagaaataatgataaaatagtgaaacagtatgagaaagcagggattgattgcagatttccggaaaggtacggcaagaagggatagaaccagaaaggatggaatacagatgaaaaaggtactgatgatgatacaggaatcatgtccttactgccggcaggcacttcgcatgatggatgaactgaaagcggagcggccggagtttcaggcagtcgaggtgaaaattgtggatgagaacagggagaaggcgtttgcggattccctggactactggtatgtaccgacgtatttcgtggatggagtaaaggtgcatgagggtgtgccgaccgtggacaaagtgcggaaggtttatgagagagcgcttgacctgtgagaggagggccgggaagcgggggaatttgctgctgactgagcgatcgtatggtatgattcccgtggacatcgagtgactggatagaaaggtacataattgtgacgttatatgagtaaagggaagaaaaactggctgatgatcctgatttatgcgggactcatagctatgtgcctcggcatcgtctggtttgtgggaaagatttcctcaccgacaaaaccgggcagagaaagcagcagcgagacgacgatggtgcagaccggagaatcgcaggaagaggaacgtgaagaggaggagagcgagagcgcggaagcgacgccatccgaggcggagacacaggaagaaagcaggcagcaggacgaaagcgggagatggtacggcagccgcacagagacggtccggccggagatagaggaagaactgccggtggaagagtatcggccgccttccatagtaacggtctctgatatccattatttcgccccatccatgaccgattacggcgaggcgttcgacgagatggtgaaacgggacgatggaaagctggttccttatatttcccagctgatggatgtgtttacggaagagatgacagagcttatgcccgatgccgtgattctgagcggtgatttaacattgaacggcgagaagggggctcatgaggcgcttgcggaaaagctgaaggtgcttgcggatcagggcgtgcgggtcctcgtgattccgggaaatcacgatatcaataatcccaacgctgcctcctatttcggagaagtgagggaggcggccgaatcggtcagcgcggaggaattcctggacatttaccatgaattcggatacgaccaggcgatcagcagagatgagacctccttaagctatatctgtgagcttgacgagaaaaactggctgatgatgctggattccgcccagtatgagccggtgaacctggtgggaggaagaatacggagcaccaccgtcaaatggatggaggagcagctggaagcggcgaaggaactggggatctcggtaattcccattgcccatcacaacctgctgaaggagagtattctgtatcctgtggactgcaccctggaaaacagcgatgaggttataaaactgctggaacggtaccgtgtgccggtcttcatcagcggacacctgcatctgcagcggaccaagaaatacaagcctgagccgggagaaccggaggatgcctaccatatcagtgagatcgtggcggactcctttgccattccgccctgccagtacggaatcctgtcatggggagacggcgggcagcttcgctatacgacgaaggaagcggatatggagcgttacgcggcggctcacggcctgaccgatgaaaacctgctgaattttaaggaatacggaaccgatttcctggtgggcgtgataagccagcagatctataagaagatgagcagtctgccggaggagcatatgcgcaagatggcggagctgtacggccagctgaaccgtgattactgcgccgggacgcccatcgacgtgaaagagataaaatcagatgaggcattccgcttatgggagcgtaaccttccggacagccggatgttcgaggagatcgacgatattctgcgcgataccaggaaggatcacaatacgtgggatttcccgggagaatggtaaaaacttcctttacaaattatttcatatcgtgctataatgatgaaataaaattacatgcgtgacaggaacggaggaagaggagccatgcaggatcatatcaacgtttcgggcgtcctgtgttcttcttacgataccttttttgaggcggaaaagaagattgcggattatatactggagcacaaaagtgaaatcatcgatatgactgtcgcggagctggctttggcaagcggaaccagcgatgcgacggtatcgcgtttttgcaggcgctgcggatttaacggttttcatcatttaaagattactctggcgaaggaggtggcggaggaacgcgggaaatccgtggaggtatccaacgatatcagccgcgataatatcgcgcagtccctccagaatatcctggccaacaaggcggcggagctgacacagacggtgtccatgatggacccggttcagctgggaaagatcctggaactgattgaacatgcccgcacggtgcagctggtggctgtggggaatacgattccggtcgccttagacggcgccttcaagttcaatcaactgggcattcaggcggtatcgggtacgatctgggagacacagatggcgtttacctgcaatatggggccggaagatgtggtgatcatcatatccaactccggtttttccaaacggctgatgacgctcaccgcggtggcgaaggagaatcactgcaagatgattgcgatcaccaacaacgccgcctcgccgctgggtcaggccagcgattaccacatcacaacggcgaccagggagaagctgcttttgggtgagttctgcttctcacgggtatcggccactatggtggtcgagattctctatctgtttctggctgtgagcaagaaggattcatacgaccatatccgacgccatgagatcgcgatttccgaggacaagaataactgatccggcgaaacgggattatacgaaaaatatggatataccatctatcttttccagcaggcattgaaaacaggagtgagtgtcagggagtatacggtgaacatgccgtaccggacattggctcctgttttttttcgtggaaggaaaatattgttcccatgacaggaaaatcccgtcctcataaaaggaaacaaacgatgatgcatgaaatcagcaattattggaaaaatacatagtaaaaaagtacaaaaaacacgcggggaaacagggaaaatggactggagatttatggaaattgacgaaactttataagaaataatatttcttataaaaatgtattgacgaaaatactaaatcataatatagtatagcaaagggaagaaataaaattttataataacgaggagaggtgacatatgatttacacagtgacatttaatccggctttggattatgtagtaaaagtaaatcacttcacgctgggaatggtcaacagaaccgtgcaggaagacatttattatgggggcaagggcatcaatgtatcggcggtactgaagacgctgggctttgggagtaccgcgctcgggtttgtggccggatttacgggagacgagattgaacggggagtgaaaaatctgggattccagtccgattttatccgggtggagaacggtatgtccagaatcaacgtaaagcttagatcggaagaggaatcggagatcaacggcaccggtccggagattaccggagcggatgtggaaaagctttttgaaaagctagagaagctgagggcggacgatgtcttagtcctgtcgggaagcatcccgcattccatcgacgacggaatctatgagcggattatggagcggttagacggaaggggcatccgcatcgtggtggatgcgacgaaggatttgctgatgaatgtccttccctatcatccatttatgattaaaccgaataaccatgagctgggcgagatgttcggtacggtgccaaaggatgaggaggaaatcatatattacgccagacagctgcaggaaaagggcgcggtgaacgtgctggtctccatggcggggaacggagccgtcttaattgctgaaaatggagcggtattttccatgggagttccaaagggaacggtgaagaattctgtgggcgccggagattccatggtggcgggattcatcgccggatatctggaaaatggaaattacgagcacgctttaaggcttggaagtgcctgcggaagcgccagcgcattttccgaggggctggcctgtaaggaagatattttgaaactttatgaggaattacgataggaggggtttttagatgagaatcacggaattattgaaaaaagaaagtatcgagctcggcgtaaaagtctctggcaaggaagaggccattgataagctgatcggtctgatggcggctggcggaaggctgaacgacagagccggctataaagaaggcattctggcccgcgaggcgctgggaagcactgcggtaggcgaggggattgcgattcctcacgccaaggtggccgcggttaaggagccgggactggcagccatggtggtgcctgatggcgtggattacgaagcgtttgacggttcgctggccaatttaatcttcatgattgcggcgcctgagggcgaagcggatgttcatctggaagcgctgtcccgtctgtccacgcttcttatggatcctgactttaagaatgatttgatccatgcggagtcaaaagaagaatttttacagctgatcgacgacaaggaatccgagcgctatgagaagaaagtgcggaaagaggagaagatagcggaggacgcggcgcctaaggtccacgagcctttaaagagcgcagccggataccgtgtcctcgcagtgaccgcgtgtcctaccggcatcgcccacacctttatggcggctgagaatctggagcagctgggaaagaagcttggcattcctgtaaaatcggagaccaacggagccgagggtgcggccaacgttctgacgaaggaagagatcgccgctgccgacggaatcatcatcgcagcagacaagaatgtggatatggcccgtttcgatggtaaacacgtagtgaaggcctctgtctccgacggaattcaaaaaggtgaggaactgattaaaaaggctgtgagcggcgaagctcctgtctaccaccatacaggtgccgctgcttcagaggaggacggagagagcgagggcatcggccacaccatttataagcatctgatgaacggcgtctcccatatgcttccgttcgtgatcggcggcggacttttaatcgccctggcgttccttttcgatgattattccatcaatccggctaattttggtaagaatacaccgatagcggcctatttaaagacgatcggcgagcaggcatttggcatgatgcttccggttctggccggttatatcgccatgagtatcgcggaccgtcccggtctggcggttggtttcgtaggcggcatggtggcaaagatgggagccacgttcatgaatccggcaggcggggacgtgaactcaggatttttaggcgcgcttctggctggttttatcggcggttatattgttgtcctgttaaagaaagtatttaaaaagcttcccaaatctctggaaggcatcaaaccggttctcttatatccgctgctgggcattttcctggtcgcggtggcaacaacatttatcaatccgtttgtcggtgcgatcaatgacggtctgacccatttcttaaacggcatgggcggcaccagtaaggtgatcctcggagccgttgtcggcggcatgatgtccgtagacatgggcggcccggtcaataaggcggcatacgtgttcggcacggcgcagctggcggaaggaaacttcgatattatggccgcggttatggcgggcggcatggttcctcccattgcgatcgcattgtgcagcacattctttaagaaaaaatttacggagaaggaacgccagtccggtctggtaaactatatcatgggcctgtcctttatatccgagggcgccataccgtttgcggcatcagatccgctgcgcgtgattccgtcctgtatcatcggttcggccgtggcaggcgggctttccatggcgttgaactgtacgctgcgcgcacctcacggcggtatcttcgtacttccaacgatcggaaatccgttcggctatctagccgcggttgtgatcggatcggtggtcggctgtgtgatactggcggcgcttaagaagaataaggctggagaggaataagcccgttaaaaaatcgaaaagggaaagatcagttggggaaaacactggtttttcccttttcgattacaatcttgtcatccgcgcagctcccaaatgtttcccgtgccattttgccagcaggatggtataattgacagaaaaagagagaatgcggtacgttcacatcaggtggggatcgcatgggaaggcaggaggaagatggctgagttcgaagaaaaagggagcgggtccatttgcagcttaaagcagtccatcacaggcagtcctttctgtttttttggtgggattaagcggagagacagagaaaggaaatgagagaatgctaacaataaagcgagtgagcctggatattccgcggggacgccggattctggcggtcagcgatatccacggccatgtccattttttgaaaaaggtgctggaaaaggcgggtttctgtgaggatgacgagctgataatcgatggtgatatcattgaaaagggaccgtattccttagaaacactccgttatgtcatggagcttgataaaaaacctaacgtccatgtgatttcagggaatgtggattcatggcagctggagctgattggaagccgcgaaccagagcggacaagggcactggcggaatttatccgaacggcaaagaaacgatggggaggaagtctttttctggatttctgtgaggaaatggggatggggcatccgcagacggaagcggagacagccgctgccagggaaaaggtgatagcccacgggcaggcggaactgaaatttttatcagagctgccttccatcgtggaagcgggcaattttatctttgttcacagcggccttcctgagcggtgggaggagatggatgggcaggaggccactccggttctgaagttcgatgactttcgaaacaggggcggaagcttcgaccggtgcgtggtggcaggccattggcccgtctgtctctaccgccatgaggtggcggaattcaacccgttttttgaccggaacaagaatatcatcagtatcgacgggggctgcggcctgaagcgggatggacagcttaactgcctgattattccggatgcagaggggaccatggaagaagtcagctggacctcctacgggggattcccggaaatgacggctgtcgacagccagcaggagaggaaggcccggatatcggtccagtacacggacaaccgtgtggaacttctgccggggcagagtccgggtacggggctggtgcgccttcgccacctgaccacggataccgtgcttgacgtaccggaagattatttatatgagcgggatgggacgctccggtgtgacgatttctgcgactatcatatggaagtaaaggcaggagagcgggtggaactggtggagactggcgccatgggaagcctcattaagaagaacggggtcagcagctggtaccacggaaggctggagccggtatagaatagaggagaaaacaatatgagcgaagctggtaagaaacaaacggaaggcgaaaccacgatcagcgaaaacagggcactgtccggcgtacctgtgatggaaagggaggtaaccgcacttctggaagagatatcctcgtgcccggaaacggcagcggtggcagtgggcggctccagagccacgggaaaggccgacaagaagtcggattacgatatctatgtgtatgtggaaatggagatagcaaaagagcggcgtaagagtatcctggaaaagtactgcggcgtcatggagatcggaaatcactattgggagtcagaggacaactgcacgctgaacaatggtgtggacatcgatattatttatcggaagcttcaggatttcgagggagatgtggcagcggttgtggagcagtaccgggcttccaacggctacactacctgtatgtggcataatcttgtcacgtgcaggatcctgtatgacagggacggagcactggaagcaatgaagaagcgttttgatgtcccctatccggaggcattgagggctgaaatcattcggaagaacagagccctgctaagcggcgtactcccgtcttacgatgcacagatacggaaggcagcgtccaggagagacctcgtcagcatcaatcacaggacgacggaatttctggccagctactttgatattctatttgccatgagcaggcagacccatccgggggagaaacggctcgtgagtctctgcaaagacagatgcaaaaatttgccggaccggtttgaggaaaatctgaaccatttattttccgttatgtacgatcctgacggggctgtcaatgatgtgatcgtctgtatgctgacagaactggaccaggctttgctgaaagcagaaaatgggcagccgtaaatatagaccacaaacgaatacgggaaacttaaaaatcccgggcggcgctgaatgcgtgcccgggattaaacgttcctgtgttcttttttgcatatcccatctattttatgaggtgaattccttcatctcttcgatctctttttcctgagcatcgatgatgttctgggcgagagtcctgatctcctcgtaattggtgtactcgaggatggatttggccatgtcaaccgccatctggtgatgcatgatcatgccctcagcaaatgcatgatcgaggctgtcggtgccggacttactcatggaatggtcgtgctccagcatcttgtcgtattcgtctaaatatgcgctttcctggtctgcatcgttatggccttccgcctcatactttttgatcagatccttcatctgctgaatctcttctgtctgagtggttttgatgttttcggccagttttttcagcttttcattgcttccgccgtattcgaggtagctgtcggccatatcgatggcggactcatgatgaggaatcatgccgtttaaaaagtcgatggatgcatttcctgtcttggggatgttctccatgtcatgcatcatgtccatcatgatctcatcctggcgctgtaagtagcggttagtgtcgtcgtcagaggctgcatcactgccgccgtggccattatggtccatactgtttttactttccgccgaaccggacgactgttccgcggtctggctgctgctttccatctccgtcggtgcgggtggaatcggcgccttttttctgcttccggccgcggcaaaggcggctattgcaaggataacgatggcggcaatgattccagtcgcccagtatttcatatttttgttcataatcccatttcctccatttcttatcggtaatcttagtatgaggtagtgatggaaggtttatgcacgatggaaaatctaatcttgtgcaggaatggatgctctggtaaaataaggataaaaaggaggcgtcttctatgcgaaccgaacaggaaatgtatacaatgataatcgatacggcaaaggcggacgaccgcattctcgccgtttatatgaatggatcccgggtgaatccggaggcggaaagggatatttttcaggattatgatatcgccttcgtcgtgagggagacggaaagctttcggaaggacagaacgtggatcgaccggtttggagaccgcctttacatgcagtatccggaggagaacgacgagtttccctcagatgtggaaaactgctacggatggcttatgcagtttgccgatggaaaccgcctcgaccttcatgtacagacgctttcctactccctgcagatgatggaggaggaccggatgttccggattttgtatgataaggctggctgtctggctgaagcgccggaaccgacggcggagcaataccgggtgaaacggccggaggagagccagtttctctttgtctgcaatgaattctggtggtgcctgaacaatgtagcgaagggactgtggagaaaagaggtgccgtatgcgcaggacatagtgaacctccatgtgcgcccccagctcattacacttctgtcctggaaggccgggattcagacgaattttacatgcagtgcggggaaatccggaaagtatctgtaccgcagcttatcacaggaggactgggaccggctgatccggacgtacgcgggcggcaggctggatgagatgtgggaggcggccgataccatgtgcgtgctgtttcatgagactgctcttacggtggcagaacagttgggattgcggtacgatgtgaaggaagcggaggcgagcctggggtttttccgtcatgtaaagggactgccggaggatgcgaaagaggttttaactgtcagtaaggaggcataaattatgaaaacatataactggggaatcataggaaccggatcaattgcgcgggagatggcgtcggccctgactgcgtgccgcggcgccgtctatggtgtctgtggaacgagcagagagaaggcggagtgttttgcggcggataacggagttctgcacgcgttcgcggacgcagatgcactgctttcggatgaaaatgtggacattgtatacatagcaacgcctcacaatatgcattttgaattcatcaggcggtcggtcctggctggaaaacatgttctctgcgagaaggccattacggtgtcgtccgcggagatggaggaagcggctgcgctggctgaggaaaagggtgtggtggtaatggaggccatgacgattttccatatgcctctctataaaaagcttaaggagatcgtagcttcgggggcgatcgggccggtgaagacgatttccgtcaattttggaagctgtaagccttacgatgtgaccagccggttcttttgtaaagagctggctgggggagcgcttctcgatatcggaacgtacgccgtgtcctttgccaggtattttctggatgagagaccggataccgttctgtcagccgtgaagcgtttcgagaccggagtggacgaacagtccggaatcgtgttcatgggcgagaacggacagatggcggttatcgcgctctccatgagggccaagcagccaaaacgcggcgtggtagccggagaactgggatatatcgaggtcgcggagtatccgagggcggaccgcgctgccatcgtctatacggcagacggacggagagaggagatcgcctgcggcgacagcaagaaggcgctggaatacgaggtggaggatatggaaaaagccgtgtcagagcaccttgtgtcagagagcatggccctttccagagatgttatgtggcttttaagcggtgtgcagaagcagtgggaagagcaggacgaacaggctggaacacagaagtaaggacagaatatggaggacaaaatcatgtatcagtgttgtatttttgatttggatggaacgattatcaatacactgcattctttaaagaagacggtgaatgagacgataaaacagtttggctacggccctattgatgagtatcacgtcaggtatttcgtgggagacggttataagaagctggtggaacggacactggtttactgtggggacacagagcttacgcactacgaggaagcgctgacggtctacgacgagatgttcaagaaatactgcttatatcagatggaaccgtatgcagggatgccggattttttaaagatgctgaaggaaaagggaatcaggatcgcggtggtgacaaacaaagcccatgaccgcgccgttgagtgtgtggagaccgtctatggtcctggctttttcgataagataaccggggagggaaagggcatgaagtgtaagccggaccccgagggcgcccttaagacggcggaggaattccatgtggagccgtcggaatgcctctactttggagatacgaacaccgacatgaagacgggaatcaacgcaggtatggacaccgtaggtgtgctgtggggattccgggacagggaagagctggaagcatttaagccgaaatacatcatcagccatccggatgaaatcagatccctgtttaacgaaacaagcgagaattctcccgcctctgcaggggaatgatgaaacaaataaacaatgaataaaattaaaaaaagacaggaaactaaagagagatgctctgagctgaaagagaggtctctcttttttgctgcatggggaagctctttagtgcagcaaaaagtctccggggacggcgcgttgcgctttaccgggcgtcctgctccggtgcaagagcctggccagcaggctcagaaacgatattttacgggataactcatcaatccaaggaggaaacatggcaaagcactggaaatggggatttgtgatactggccgctgtatgggccgcacttttcggaaacatgctggggtatgcctggaatgtgacgcatcgggaggagccaatacctgaagtgccaatggaacagatccagaatacgaatataagcgaggtggcccaggagacgatggaccggttctggacggtggctgtgtttggggtggattccagggaaggaaagcttggaaaaggcacgcggtccgatatggagatggtattaaatatcaatctggagactggagaaatccgaatggtgtcggtttaccgggacacctacgttaagattgatgaaaagaataaatacgataagatcaatcaggcctattttgaaggcggtccggctcaggccatatgggcgctgagcgaaaatatggacttaaatatcgacgattatgtttccttcagctggaaggccgtggcagatgcgattaacctgttaggagggatcgacgtggagatcagtccggaggagtttaaggtcatcaatggctttattacagagaccgtggagtccacaggagtcggttcccaccatttgaagaaggcgggaatgaaccatttggatggggtgcaggccgtagcgtacgcaaggctgcggaagatggatacggattttatgaggacaaaacggcagcggctggtggcggagctggtgctggagaagttaaagcaggcagatttgggaactgtgcgtcagctggcattttccatactcccttccgtgtcctccagcgtggggatgaaggatattctctccctggcgggtactgtgtcgaaattccatttaacggagaccgagggcttcccatttgaactgaaggatgcactggtgggaaagaaggactgcgtcataccggtcactctgagagacaatgtaattcgtcttcatcagtttttatttgacgaggaggattatgtgccgtcgcagcaggtggaggagatcagtgagcagatcgagcttcacaccaaaaaaaagtaagtgttcagcttccgcaaaagccataaaaagtaaaaaaaacacttgaaaaaacagttagcatatgctaatctatatgaagttagcaacaactaacttatggctttcaaaaatctggatagataaaataagtttactccggggataatgagaaagcggaaggagtgaaacggatgtcaacagacgcaattatgtcatatatttcagagtgcagccacgcaggaaggctggagtttcaggtttccatccagtgcgcccccgtattaaagggaattaaggcgtctaatcttgtgaccatggcaaagggatcgctgcagaccgtaagaagcgcccttgcaggcacagaaattactgcagtcatgctggcagccggtgacaggacagaggttctgtttctgtaccgcttccccatgctgaaagcacttctggcaaataaggaaataagaaaatttttaaaatcctgcggatatgtgcagtttgatctggcttccattctcatgggattaaaacgcaaatataccgcgtatctggccggcagcggagaatttccgcacgaactgggcgttctgctggaatatccggtcgaggatgtcaaggattttatccgttacagcggagagaaattcctgtttaccggttactggaaagtatatcacaatcctgcgcaggccagacttaaatttacccggtatgaccgggcgagagaggccgccatgcagcagatcataaatggaagccgcctgtatgaagtggcggtaagaaaaggagaataaaacatgagcgatatttatgtagtatattttagttcaacaggaaatacagaggaaatggcaaagcacgttgcagacggaatcgagagaaagggtggaaacccgatacttacagagattggaagcgcagatccggatcacttaaaggaggcttccgcctttgcactcggctgtcctgcctgcggcgcagaggagttagatgagagcatggagtccttaatcgaggagatatccggttctctggaaggcaagcatgtcgggctgttcggttcctacggatggggcggcggcgactggatgcgcgaatgggagaagcgcatggcggagcgcggcgcgaagatcgtcggcggtgagggcgtcatcgctctggaatccccggacggagacgcggagaagcagcttaagaacctgggtgaagcgctggcggagcttggcgctcaggcttaacctgagattaagattaatgccgccggacttaatagttggccggcaggaattgtttcgtataattcctgccggccattttttttaaggagcatttggcagtgcttcctacggtgtatttggctccagcaccacgaatgactgcggttccagaacgatttgtccgttctcccatctgccgctgccgatggagtagatggcagacttctgaccgtcagaaggtactgtaactgtctcgcctgacggattgaccgcaatggtcagtgcgcctcggcggtatacgaagggcatcgctccctttttagcatagagcggctcaaattccgcgtcggcctgtaaatctgcctgatcatggcgcagggccagcagggcttttacggtgtgaagcagggaatccggattggattcctgattttccacggtgggcgcgtcggaggcttcatcaactgggagatagaggctgtctttatccgcatcggagaagcccgcattttttccgctgttccactgcatcggtgtgcgggaaccggttcggaagtagccgccttcctttgtcgccagctctaaatagtgcattccgatctcatcgccgtaatagagatagggaacgcccggcatggtaaaaatgaacgcaaaggccagcttcagctcagtctcatccagattatagcggggacggagtgtgtcgtgattgcaggtcaaaagacagaagtaaccgtcctccttcgaagcttcatatttgggcaggtaatcgtctaagaaccttgtaatatctccgtggctgtcctttttgaagaagctgtggtcctcctggctctcatagtcgcgcatcagggtgctgtaaccattgccgcgtccatttaagaagaaatccatgtggaagcctgccttcagcgcgagccgcggattgccccattcggagaccatggcggcttccggatagtcgctgtccagcatttccctgacatctcgccagatggcacaggtgccggtcttttcctcatcgtcgttctttaccagggaggcggccatgtccacacggaaaccgtcacacccccggtcgagccagaaacgcatgacatccttcatggcctctctggtggcggtacagtccggatgatcggtggggagctgccacggctccttcggatctaagaagccgtagtttaaggccggctggcatttgaaaaagttgagtacatagacgccgctgcgttcgctctctccgccgatatacggaaagcccttggcgccctcgaaacagtgattggtccagatgtagcggttggagtattcgttggtctccgccttctggctcatggtaaaccactcgtgttcctcggaggtgtggccgggaacgaggtccagcagcacgcgaatgccccttttgtgggcctcctcaaacagatggtacagatcttcgttggtcccgtagcggggggctgccttcttataatcccgtacatcgtagcccgcgtccttaaagggggagtcgaaacagggattgatccaaagggcattgcagcccaagtcccttatgtagtccagcttcccggtgattccctgaaaatcaccgatcccatccccgttggtatcctgaaatgactggggataaatttcgtaaaatactgcgtcttttaaccattgcggcatgaccatttcctccttttaatgtaacagctcagatggctcattcataattcctgtttacgatgctattgacatctgctatattgataatatactataaaaaagaaaggaaatcttgcaaaataataccggatagtaacacaattctatgataatggggaggataaatggaaatggagagaacggggcttaagactgggagcacaggcggccggatgccggactataaagagaagacaaatcacggggatgcgctgatgccggtccgctattaccactgttccgtgccgaattcgtacagaaatctctccctgcactggcatgaggagatggagatcaccctgatccggtcgggggccatctattacgatatcgattttgagacattttcggtggaggaaggggatctgcttctgatttctcctcacatgctccattctgcccatgagatgccgggaaagaacatggtgtcggacagcctcgtgtttcatctcgacttcctgggctaccaggttccggatgcctgtaccctgaagttcttaaacccggtccagtccgggaagctgcgttttcttccggtcgtgaagccggggacagctggctatgaggagatgaaggcgtgttttgtccttctcttaaaatgctttaatgagaagcagtatgggtacgagctgtacacgaaggaactgctcatgcggtttttccgcctgctgtaccagtacggatgtgcggcgaagcacgagggaagcaacggagaatccggcgccgaggagaagttaaaagaggttctttcgtatattcagtcaaattacagggaaacgttatccatagaggagctggcatcggtctgccatttcagccagactcattttatgaatttctttaagcggtatgcaggtatgacctgcatagagtatatcaaccattaccggatcaccagggcggcggccgatttggtggagacggaacggcaggtgatggatattgcgctggaaaatggcttccggaacatttcttattttaataaggtgtttaaggaacggttcggagtgacgccggggagctaccggaaaaacagcctggaaaacctttccctgtcctgtaaaatgtgatatactatgcagatggaatcagattggagacgtaatgaatgaagaaaaatagaagaatcccgcggaagttctgcatcggaaccgtgattctggctatgattttaacgggatgtgccgggcggcagattccctcagcggagccggaagcagagggcgggaagctgaatgtggtgacaacgctgtttccttactacgattttaccaggcagattgccggtgaacatattaacctgaccatggtggtaccggcaggcatggacagccattccttcgagccgacgccggccgacatgatcacgattcagaacgccgatgtgctgatctgcaacggcggagccatggaacactggctggagcgggtcctatcggcggtcgatacctcccacatggccgtcatgacggggatggattacgtggataccgttcaggaggagattgtggaaggcatggaagaggaggcgcatggccacgaccacgaccatagcgttgaccacgaccacagccacgatgacctttacagccatgatctgtatgacgacgacggccatggagaagagatcgaatacgacgaacatatctggacctcgcctgtgaacgccatgaagctggtgaagggcatcgaagagaccctggctttagcagatcccgggaaccgggcggcctatgaagcgaatgcggaaagctatctgttgaagcttgaaaagctggatcaggagtttcgtgacgtgacagccaatgaaaagaggaacatgataatcgtgggggataagttcccttaccgttattttgcggatgagtatggtttgcgctacagggctgcattttccggatgcagtacggatacggagccaagcgccaaaaccatcgcttacctcatcgataagatgaagacagaacagattccggtcatctactatccggagctgaccagccaccgggtggcggagatcatctccgaggaaacgggcgcagaaccgctcttactgcattcctgtcacaatgtgaccaggagggaatttgacagcggcgtgacctacttagacttaatggaacagaatgtgattaatttgaaaaaaggactggaatagatgaattcattgatacaatgcagccatgcggatttcggctatgaaaaccaggatgccgtggtggacgtcaccatggaggtgaatcccggtgattacgtctgcatcgtcggagagaacggttccggaaagagcaccctgatgaagggaatgctgggactcttaaagccgacgaagggcaccatatccgtgtcggatgaactgaaaaagagcgggatcggttatctcccgcagcagacggcggcgcagaaggatttcccggctacggtcggggaggtcgtactgtccggctgtttgagcaggcgcggaaacaagcctttctattcaggaaaggaaaaggcgctggcggaaaagaacatggagcggctgggaatcgcagagctggcaggccagtgctaccgcgacttatcgggcggacagcagcagcggaccctgattgcccgggccctgtgcgccacggacaagctgctgatcctggatgagccgattacgggcctggacccttcggcaatcctggaattttacgagattatccgaaaattgaatcaaaaagagggcgtggcgatcttaatggtatcccacgatattgcaaatgtggtgaagcaggcgaaaaagattcttcatttaaagagagaggtgctgttctacggcacgacggaggagtatttgaagagcagcgcgggccacatttatctgggaggtgagctttgatggaaatggtgagagagatgctttcatacccgttcctcgtcagggccttggtgggcggaattctcgtctcgctctgcgcgtcccttctgggtgtgagccttgtgctgaaacggtattccatgattggggacggtctgtcccacgtgtccttcggcgcgctctccatcgcggtagcggccggatggtcccccttaaaggtatccatccccgtggtggttctggcggcgttcttcctcttaaggatcacggagcacgggaagatcaagagtgacgcggccatcgccatgatatcggcggcggcccttgccatcggtattatcgtcacctccatgacgaccggtatgacgaccgatgtgagcagctacatgttcggtagcattctggccatgagcaggacggatgtcagcttaagcgtgatcttaagtgtcgtggttctggggctgtttctgatctgttacaataagatttttgcagtgacctttgatgagaatttcgccagagccacgggagtgaacgtctcgtggtacaatgtgctcattgcgattctgacggcgatcaccatcgtccttggaatgcggatgatgggagcgatgctgatttccagcctgattatctttccggcgctcacatccatgcggctctttaagagcttccgcggcgtggtgctgtcctccggcgtgctgggcgtggtgtgcttctgtatcggcatggtgatgtcctaccggttctcgacaccggcgggagccagcgtcgtcgtcgtcaatctggcggcatttctgctctttacaggggcagagtgggcgctcaaattccgaaccggcggaaaaaagccggaattaagtgaaaatacggaagcagaaaggcagtagcagcaagatggatgagaaaaaattaattcatgcccggcgccatgtgagccagacacagtttattgcatatggatttttctgcgttatcataacgggaacacttcttctcatgcttccctttgccagccgcgacggacagtcggagccatttttaaactgtctgtttacggctaccagcgcgtcttgcgtgacgggccttgtggtggcggatacctggagccagtggtccttatttggccagctcgtcatcctgaccatgattcagatcggcggtctgggctttatcacggtgggcgtcttcatatccatcgtgctccgccgtaagatcgggctgaaggagcgcggactcatgatggagagcgtcaataccctgcagatcggcggggtggtgcgcctggcaaagaagattatcatcggcacgtgtatctttgagggaacgggcgcggtgcttctggcaatccgctttatcccccagtttggtttctttcggggactgttctacggtattttccattccatatcggccttctgcaacgcgggcttcgacctgatgggagggcagacaccgtacagctcttttgtggcctattacgatgactggctggtgaacttcgtcatcatgtcccttattattatcggcggtatcggctttatcgtctgggatgatttaagccggaataagctgcatttccgaaaatatatgcttcagacgaagattgtactcgtcaccaccgcgatcctggtcttcggcggaggactgctgttttatctgctggagaggaatcatcttctggtgggaatgaataccagcggaaagatcctgacctccttattcagctccgtgacggccagaacggccggcttcaacacgacggacacggcggccttaaccgatggaagcaagctgctgaccatcatcctgatgttcatcggaggaagccctggctccactgccggcggcatcaagacgacgaccctggtggtccttctcttgtgcgtacattccaatatcaagcagacgtacgggatcaatatcttcggccggaggctggagaacgacgcggtcaagcgtgccggaacgattctgacgatcaaccttttgctggcagtcacggcgtcgctggccatcatggcgatacagccgctgggattttccgatatcctgtttgagacgttttccgctatcggtaccgtcggaatgaccacgggaatcacgagagcgctgcatccgatatcgcgctgcatcatcattcttctgatgtactgcggcagaatcggaagcctttcctttgccctggcctttgtccagtccaagagaaagccccatgtacagcagcctgcggaggcgatcaacatcgggtaagcccgcagccggtgcctggaagtgaagagatcatgtattgaataatatgctgcgaagcaaaggagaatatcatatgaaatcaattttaatcataggaatgggacggtttggccaccatctctgcgagaatctcgccatgctgggaaatgacgtcatggtggtggatcagaaggaagaggtgttagaggacctgcttcccatcgtgaccagcgccaagatcggagactgtaccaacgaggcggtcttacgaagcctgggaatcgccaacttcgacatctgtttcgtctgtatcggaacgaatttccagagcagtctggagatcaccagccttgtaaaggagctgggcggacgccgtgtcatcagcaaggcgaaccgcgacattcacgccaagttccttctcagaaacggcgcggatgaggttatctatccggaccgtgacattgcagaaaagatggcggtccgctacagcgccaaccacgtatttgactacattgaactgacacaggaatactccatctacgagattccgcctcttccggaatggatccacaagaccatccgcgaggccgatatccgcaaccgttaccacatcagcgtcctgggcatcaaacgcgagggaaaagcccagctcatgcccccggccgactatgtcattcaggcgcaggagcatctgatggtaattggaaaaaagatggatattgacaatatcctggaaaagatgaaatgatgtgctcaaggttcgagtaaatgatatcgccgtcccaccggtcagcttctggtggggcggcgtttttgtgtttcataggaaagttcatccgatatggccgctgaagcagccgcgctccggcgcgagagtccggcaagccggactctttattctgtaacaggaacctttgctataagaattttaaattgctggactggccctcggtggtgtaggtggcgatatttttcacatatttgccgggggagactcccatgattttatggaacaccttgacgaaatgggagtaatcattaaatccgcattcgtaacaggcgtctgtgatggaggccccctgttttaagaggattccggcgtgctggatgcggcgtgcgatgatgtagttccacagggatgttccggtatagttcttgaatatatggctcagacgggaaccgctgatattcagtgcggcggcgatcgtctgtatggatatatcatgggtcagattgttattgacatagcccagggcctggcggattatctcaggggatacgtcacccgcagaggcgaattctgaacggatggcctcattcgcacagaggagaatccaggagagacaggaccggattcggatatcatacccgaattcttttttatttaagctgttgataatggtatccacacacgcttcgtattgctgaagctgccggctgtccagatggcagggatggtccggagtgaacttccgaaaacaggcgaagagatctgtttccggggttgacagggaggcggcaaagctttcttcgaaatggacaggcatacgctcatagggcgtctcatcgctgatgaacaggccgtgtatgtcattcggacaaatgaaaatcagatcgccgggcataaggcggaaggtgacatcattaataaaatagtctacattaccgcttttaaacagcagaagctcgtatgcgttgttgtgcatatgcagggtacggtcctgcttctggcaggtgcggtgatgggaaatcagcagctggttaatggattgtgtggtgatttcaaacattggaagctctcctttctgacgatatgcgcagcatgatatgacataaatatagcataaaaaacaatattatgaaaagaaaattatgatatgataagtcatatggttaatatagacaaaaaaagaaagatgaaagtggaaaagatggacataataatgaactcgagaaatgatatggttcagctgtttctggattttataaggccgctgaaagcattttacagtccgaagagggcatttcttcatgtggggaatacaggggcccattacggtgaaaagtcggccaggatggaaggatgggccagggtgctctggggattggggccgctctggtcagcggataactccgggcttcccgcagaacagcaggaggagataagggagtggcttgtactctatcggaccggtatcatccatggaacggatcccggggacagcgagtactgggccgacatatttgattatgatcagaagatggtggaggtggcggcgctcgtattttcgataacggtcaaccgcggggagctgtgggacacgctgactgacggccagaaggacaacctgtaccggtggctgagacagatgaatgactacgacatgccgaagaataactggaggtatttcagaattctcacgaatatgacctttcggctgctggggctggagtggcaggaagatagaatggaggaggactttgcgctgatcgaaggctcctataccggcgatggctggtattacgacggcaatccgggccaggtcgattattatgtggcattcgcgatccactattacggactgatctacgcacaacatatggaggcgctggagcctgagagatgccggatcctaaaggaacgcagtacgaagttctttgatgattttgtctactggtttgcgaataacggggaagagattccttttggaaggagtctgacctaccgttttgcacacagcggcctgttcggagcgatggcctacgccagactcgatgtggattacggcgtgctgaagaatctggttttgaggaatatcgaggtgtggatgcagcgccccattttcgacaacacggggattttgagcattgggtacggttatccgaatcttttgatgagtgagagttacaatggatgcggttccccctactggtgcaataaggcgtttatcgtgctcggactaaatgaggaccatccattctggacggctgagcccaaggtgtacccttatgaaccggtgaaatatttaaagcacccgcacatgattgttacccatgatgacaacgatcacgtgctggcttacgtgacggggcagcatttggggctggatcacggcaggggcgcggaaaaatatgagaaattcgtatactccaaccagtttggcttcagtgtttcgagagggaccagcctggaacagggggcgtttgacaatactctggcattttccgtaaagggagagaaccgttactgcatgagatacggccagacagacttttcttcggatgaggagaagctttctgcaaaatacagcccgttgaccggtgtggaggtaataagcacagtggttccctgctccccctggcatgtgcggattcaccagattaccaactgcgtaccggtaacggcagcagacggcggtttttccattgctcgggagcggtgctttgaagtgacggagggagccgggacgggcagactggaatcggagaatatcgaaatcacggaagcttctgcatttgtaagggctccgtggggagtaagcggaattgtgaccgaaactgaggggacgacaaagcttgtgacgccgtttccgaataccaatttattctataatctcacggttattccgaccgtgacagcggaactggaaccgggcagccatttactgattaccagtgtgttcgcagaccgctccgccagtgccggggaaatggccgggcagaagcctttcgtgagtgtggaagagggaagcgttacgattgcatacagaggcaggacagtgactgtcccccttttatgacataagaaacaagagaaaggagaatgcaatgtatttatcacaacaggatgcggcatgggctgctgagacaatggaaaaaataaaaatgaagatgaagcctgtgacagaacgcagccgcagcaagataccgtataccacggtggacggcgtcttcgatgaccggtccggaagccgggatatctcctggtggaccaacggcttttggggcggtatgatgtggcagctttacgctctgacgggtgatgagctctaccgggagacggctgaggagctggagacaaagctggatacggtgctgatgcgtgcagacggcctggaccatgacaatggttttaaatggctgccaaccgcggtggcggactacaggctgacgaagaatccagagtcccggaacagagccctgctcgctgccaataacctggcaggcagattcaatcttgccggtaactttatccgggcatggaatgactggggagaggatgatcaccgcggatgggcgattatcgactgtatgatgaatctcccgctgctttactgggcctccgaagagacgaaggaccccagatttcagcagatcgctgtggcgcatgccaatatggcgcagcagtgtttcgtgagagaagacggttccgtcaatcatatcgtggaatttgatccctttaccggagagatggtgcgaagccatgggggccagggctatgagaccggttcttcctggaccaggggacagagctggggcttatacggctttgtgctgagctacatacataccggtgacgggcattatcttaacacggcaaagagaatcgcccattactttatggccaatacgccggagaacggcctgattcccgttgatttccggcagccggccgaatgcgcctgggaggattccactgcggcggcgatcgcgtcctgcggtctgatcgagctttccaggcacacggagggcagagacagcagcctctataggaatgccgcggtgaagatgttaaaggccctcgacgcgtcccgctgcagctgggggacggagaaggatcatctgctggagcggtgtacggcggcttaccacgataaagaacatgaaattgccattatttacggtgattactattttattgaggcaatatggaagcttgctggtgaagatttgtttatttggtaatacaaaagttgcagttactgccgataatacgaattatgtcatgtattatcggtatttttatgcctaaataggacagcagccgattaaaaatctgattattctgactcttttatctggaagacgcacttcctttctcgcacaatgcaagctattccccaatctcgtaaaattaagtccaccataattcgtattatatttccaaaatcaaaatctggtttttccaggtaaagataaatgaagaaaatggaggattaaaaaatgaagaaaagaagattggcagcgggtgttatggcggcggttatggcagcaggtatcgttgcaggatgcagcagtacaggcgctggggccaaaggaagtcaggaggagaaggtgaccattaaggttgccctgtgggattattccaataccgaatattacaagaccatgtttgatgcatttacggcaaagtatcccaatattaccgttgaaccggtcgaattctctgcggatgagtacgataacacggtgatcacacagctgggcggcaaacaggactttgatgttgtgttcacaaagggaacacctgcactgagcgcgctggtggaacagggacacgttctggcgctggacgatcttatggggaaggacgcctcttttcagaaggatgcgtattccggtcttgtggaccagcttcagctaaacggcaagacgtatggcgttccgttcagaaaagacaacaatatgatattttataacaaagacttatttgacaaggccggcgtcccttatcccgaggacggcatgacaatggaggaataccatgagctggctgccaaaatgacgagcggaacgggaaatgacaaggtctacggcgcccatgtccatacgtggcccagcaatgtgtctgagttcgccagacgagtcgaagagtttgacgttctcgatacggacagctatgaaaacctggtgccgtattatcatgagattctggccatgcaggacgaagaagttgttcaggactacggtatgctgaagtcctccaacatccattattccggcgtattctataaccagcaggcggccatgcttcagattggaacctggtttatcaacatgtgcgtggaaaatgtaaaagacttcaactggggtgtctgcagccttccaaacgacaaaggaatcggcaatgaggccgcgatcggcggcgtgactccggtatccatcggggcttacgcaaagcatcccgaagaggcgtggacctttatcaactatatctgcggagaagagggggcagaggtccttgcaaaacaggggattgtcccaggctacaactccgatcaggtcagccagatctttgatgatattcccaaaacatcgcccaatgctccggaaggcttatcaaagtatatcgatatagataagtatgtagtggagcagcgtatggacaggcttgccaaggaaattgataacatttaccaggaacagcacagcgccatcatgacaaagagtgtgacggtggaggatggtctccggaagatggcagagagagttaaggaagcgcagtccaagtaactggagaaaggcggacatatgaacagagaaaacagcgcggcccaaatttcgaagaaacggtctctggccagaaaaaagaacttagtcgcatactcatttatcctacctaatttaatcggatttttcatttttacatttataccgatcgtcttttccctgctgctcagtttttgcgaatgggattccgggaatccggttaaattcgtaggtttaaagaattttatcacgatgtttaccaatgatacaagcttttggattgctttgaaaaacaccctttattatacggtcgtgacagtgcctgtaacgctggccttatcgctgtttctggccattctgatgaacaaaaacttaaagggccgggtgtttttccgatccgttctcttcttcccatacgtggcttccctggtagccgtggccgtggtctggatggcattattcaatccggaccgcggcccggtcaacgggcttttgatggcgctcggtgtgtccaatccgccgagatgggcggcgtctacgacctgggccatgccgacgatcatcggcttgaccgtgtggaaggggatggggtactacatgattgtctatctggccgcgctccagggcgtatcgggcgatttgtacgaggcggcttccctggacggagcaggcagatggcagcagttccttcacattacgtggccctgcgtaacccctactacgttctttattctgatgatgctgatggtatccaccttcaaatcctatgatattatgtatatcacgacacagggaggacccggcgaggcgactaaggttctggcttaccatattttcaacagcgcgttcgtaagctccaggttcggttacgccagcgcggtggccatggttctgttcgtcattatcatgggtgtgacactgattcagtttaaaggtgagaaacgatttacaagttacttataaggaggcagcagtatgaagcaggcagataataaaaattcggctgtctctgcggttaagacagcgtttatgtacgcagcactgattattatggcagttattatgcttattccctttgcatggatgctgtcggcatccctgaagttcgagaaggatgtattctcctttccgatcgtatggataccgcccgttccccagtggggcaactatgcagaaatatggaagaaggttccgcttctgacgggctttttcaatacgacgaagctgacggtatgcaccaccgttttgcagctggtcacgtcgagctttgcagcttatgcatttgcgaagctgagctttaaggggagagatactattttcatgatgtacgtcatgacgatctcaatcccatggcaggtgtacatggttccccagtacaagatgatgacgttgtttggcctgaccgacagccatctgggcattattctgatgcatgcgtttacagctatgggcgtattcctgatgagacagttttttatcggaatccccaacgaactgctggaggcggcgagaatcgacggcctgagtgagtacggaatctgggcgaggctgatgcttccgctgtcgaagccggccatcgccactctgtgcattacctcatttacctttgagtggaacgattttatggggccgctaatctatttgtcttcccagaaaaagaagaccattcagctgatgctccgcatgtttaacagccagtattcttccaactatgcccagattatggccgcggccacagtagccctgatcccggtcctgattctgtttatctgtttacagaggtacttcgtggaaggcgtggcgagttccggtatcaagggatagaagctaattcaggaaagaaaaggagacggtatgaaatactctttatttacggtcagtgtaccggaaatgacgccggaacaggcgcttaagaagatgaaggaatacgggtacgacggtgtggactggagggtgacggatctcccaacaaatcccgggacagcaaaggaggcgccgtcttactggaaaaacaactattgtacggtggatatcgccacgatagatgagaaagcgcaggaattaaaggcgctgtctgatcggtatgggatcaaggtaaatgccctggcaacgtatttaaactgcgccgacagtgaggccaggattgagtcgtgtatgacggcagccgtgaagatgggctgtaaccggatccgcgtcaattctctcccctatcataaagggcagaattacctggagacctttgaacaagctgcagccggatttaaaaaggtggaagtgctcgccaggaagcatggggtaaaagctgattttgaaatgcacatggggacgatcacaccgtccgccagcgccgcataccgcctcgcctgcctttttgatccgcggaatattggcgtgatctacgatacgggaaatgtgatctatgaaggcttcgaggagtatcagatggcctttgagatacttggaccgtatctcgacctggtacatattaagaatgcgtgctgggtgaaaaagaacgtggatggaaacgaaaaatacgtccccgactgggccccgtttacagacggatatgccgattttgaacggtgttttcaggcgcttaaagcggtggggtatgacggctatgtgacctttgaggatttctcctccgcggaaagctcagagcagaagctgaagacagatattgactgtatcaggagaatcgtggacgccgtggagcggcaggaggagggcgcgcatgattaggacattctgcacccatgagatccgaaaggtccgggaattgagcggcagcctgtgggaattttcgccctgtacaggtgatctggcaggcagaaaataccggacggctgttccgggctgctgggaatccatgcctgatttttcctcttacaggggagtcggcgtgttttccagagagattgagacggaaggggcgttccggctggtattcaagggcgtcagtcatacggcaagggtctgtctggatggaagggagataggcagccattataatgcttatacgccattcgccgtggctgtcacagatgtgatggccggaaggcacctgctggaggtctatgcagataatacgttcggcgaggccagcgcactccacatacccaatgactacatgagctacggcggcatcagccgcggtgtccttctggaggaattgacggatacgtacattgaatacattcacgcagtcccggtcatggagaaggacggctggaaagccctggtttcagtgaaggttaaaaattggtccgcggccgggaaagcatgcagactttatctggacctggccgggattgcctctgaagccatggaactgacactggaggcaggcggggagaaaaccgtggactttcaattgtccgcggcagaggcggaggcctgggagatcaaaaacccgaagctctatacagtccgggccacgctttcggatgaaaacggagcgtttgacgaccagatcgaccgcatgggattccgcgagattaggacggagggcaaagatattcttttaaatgggaagaagctgcgtatcagggggttctgccgccacgaggaccatccgatgttcggatgcgccctgccctatgcggcgatccagcaggatctggagacggccatggatttaggggccaatgccatccgtaccgctcactatcccaacgacgaactgtttcttgatctgtgcgatgagcagggaattctggtatgggaggaaaaccatgcccgggggctgacgctggagcatatgcagaatccgaatttcgagcgccaggcggaaacgtgtatcgaggaaatgatcacggctcatatcaatcacccgtctgtcattatctggggcattttaaatgagtgtgccagtgatacggagtacggctatgagtgctataagaagcagtacgacttgattaagcacatggatttttccagaccgaggtcgtctgcaagctgtaaatttaagacggacatctgtttcgggcttccggagattgtctcttataatctttatccggagtggtatcatgagacgccggccagtgagtatgtgaaggatatctatgactgggttcagcgtgagagcgaaggaagcggcaagccgtttctggttactgagatcggtgcgggcgccatctatggtttcagaagccacactctgtgcaaatggtcggaggaatatcaggcaaaggctctggaggaccagattacggcggttcttgagcaggaaggctgtagcggtatctttatctggcagctctgtgacgtgagggtcagtgacgagtggttcgccagccgcccccgcaccatgaataataaggggattgtggatgaatacaggcggcgcaagctggcctatgatgtggtaaagcggatttaccacgcttacgaagataaatgacagggagagcagcaggggaaaaccgcgtttagaaaacgcggttttcccctgctgttttttttaaagcctgttcctctttcctttaaaaatttccgcatagttggatttattttccttattgagaattattttcaataaagtacttgattttttatttggattagcatatactaactactgtaaagaaaatgaaattgagaataattttcaaaattaagcagaggtggtgaatatgatgcctttaaccatggtaagaaccggcgaagcacaggtaatacgtaaaatcggcgggaacgaagagacgaaacgttttctggagaatcttggttttgtaacgggcgcagtggtcaccgtggtatcgacgatcagcggaaatatgatagtcaatgtcaaggattccagaatcgcagtgaatcaggatatggcaaaaaaaattatggtttagtaggaggaaaagaggatgcagaccttgaaggaaattccatgcggcacgaccgtaaccgtgaagaagttaaacggagagggcgcagtcaaacgccggattatggatatggggatcacaaaaggctgttctgtatttgtcaggaaggttgcgccgctcggggacccggtggaagtaacggtgcgagggtatgaactttctttgagaaaacaggatgcggaactgattgtggtagagtaaaagatcagggaagggcggacgccctatattttaagaatgagagttagagatggctaactaaaggaggaacaagagtatggcaatccgtattgcactggcaggtaatccaaactgcggaaaaaccaccatgtttaataacttaacaggctccaaccagtatgttggaaactggcctggagttacggtagagaagaaggaagggaaactgaagggaaagaaagacatcattatcaccgaccttccgggaatttattccctgtcaccgtatacactggaagaggtcgtaagccgtgactatttaatcaatgagagaccggatgcgattattaacctggtggacgccacgaatctggaacgtaacttatatttgacgacacagctgctggagctggggattccggttgtcatcgccctgaacatgatggatctggcggtgaagagcggcgataagatcgacgagaagaagctggcggcagcgtttggctgtgaagtggttgctacctccgccttaaagggcgagggactgactgaagtggtggaccgtgcggttcgtctggcaaatgccaggaccattcaggtgccgaagcatgagttttccagagaggtggaaggctatctggccgatatcgcagacctccttcccaattccgttccggaccatctggcgcgctggtacagcatcaagctgttcgagcaggatgagaaggtcctgggtacgaccccgctttctgccgattcctcgaagcgcatcgtggaaatcgtgaaggatgccgagaagcagatggatgacgatgcggagagtatcatcaccaacgagagatacgaatacatatcgaaaatcattacgggctgtttaaagaagaaccgaaagggaatgaccgtttcggacaagattgacaggattgtaacgaacagaatcctggcgcttccgatctttgtggccgtgatgtttgtggtctattacgtttccgtcacatcgctcggaaccattgttaccgactttaccaacgatacgctgtttggcgcatggatccagccggccgttcagggcttgatggagaccgcaggtgcttccgaatggctcgtttccctggttgtggatggtatcatcggaggtctggcggctccaatcggattcgctcctcagatggcgattctcttcctgttcttatctgtcctggaggactgcggatacatggcgagagttgcatttatcatggaccgtattttccgcagattcggattatcgggaaagagctttatcccgctgcttatctcttccggatgcggcgttccggcgatcatggccactaaaaccattgaagatgataaaaaccgccgtatgaccattatgacatcaaccttcgttccctgcggcgcaaagcttccggttatcgcactggtagcaggtgcgatcatgggtggggcctggtggatggcacccagcatgtatttcatcggaattgcatcggttatcgtatcctgtattattttaaagaaaacgaaaatgtttgcaggtgatccgtcaccgttcgtaattgaacttccgcagtaccacgttccgtcagtgaagaccgtgctgcttcacgtatgggagcgtgtatggagcttcttaaagaaagcgggaacaatcctgttcctctgctgtatggtgatgtggttcctggctacgtttggcgtggaaaacggcgccttcggcatggttgaggatatggaagcttccttcctcgcgatcatcggcaccttcctcgctccgatctttgctcctctgggcttcggcagctggcaggcggttgcatcctccctttccggattcgtggcaaaggaaggtatcgtcagcaccatgggtgtccttgccaatatggcggaagcgacggagactgacgctgctctgtggcagtacgttatgactgatttcttccacggaagcgcccttgcaggatttaccttcttaacctttaacttactggattctccgtgtctggctgcaatcagcaccatggcgaaggagatgggaaataagggctggaccgcgtttgcagttatcttccagaatgtatttgcttatgcggtatgcttaatgatctatcagctgggatcattcgccatgggcggtggtttcggtattggaacagccgctgctgttattgttcttgctgtaactctgtatctgctgttccgtccggctccgaaggctgacaagaagacaggagccgtagcggccagaatttaagcagatgcacagcaccatcgtaatgacctggaggacggactgccaggagactgaatagaaaagagggatacttatggtaacttggatagctgccaatgcggcgacaattatgatatcactgatattactcgtattgacgggacttgcgatccgttccgtgtataagaaccggggaacctgcagctgcggaagcaagagcggctgcggaggacaatgcagttgctgccatggctgcgctccaagccataagccgcgctcataacggggaggttgataagatgaatcaggctgatatcctcgaagagaaacgcgcctatgtgattcgggaattaaagaaaaacggatgcagaatcacaaaccagagacagattctgatcgacgtgattctgcaggacgaatgctgctgctgtaaggaaatgtattatcaggcactggaaaaggaccccacgattggaatggccactgtttaccggatggtgaagaccctggaggagatcggactgatccagagaaagaacctttaccggatagacggagacagcgccagcgcctgaagggatcaaaaacccgggcaggagaagagctgacggtgctcaatgagaataacaggaaccggccgtggtacccgtgcagacagctgcagggcgccgcggccggttccttcgttttcggaatacgggccaggggtggacttatgggaaaaaatcgtatatgatagaaacgatacacacgggatggaatggggaggaactgccatgtatgagtccggagaaaattatctggagacgatcctgcgtctgagagagaaaaatgggacggtgcgttccatcgatatcgcccacgaactgaatttcagcaaaccgagcgtgagccgtgccatcggaatcctgaaggaggacggcttccttgtggtgggagcgaggggagatatcgagctgacgaaagaggggcttgaaaaggcggagagtgtctacgagcgccataagctgctgactgcatttttacagaaggtcgcaggggtcggcaggaaggcggcagaggaagacgcctgccgcatggaacatattatcagtgaggaagtatttttgggaattaaaagatttatgagcgagcagagcctgtaggtttctgcttttctttatctttggatgtaactttttgagaaaaacggagtctatataggtgaaggcggtttcgagtgaagaaaaaacaaaggagagacgtccgtgggagtgagatttgaagaagtttaccagaggcagaaaaacgcggtatacggttacctttcctatatgacgaaggataaagatacggcggaggatttggcgcaggagacctttttgaaggtctatctggggcttaagggctttaaggaggactgcagtgaaaagacgtggtgcctgacgattgcgcggaacacctttctttcctttgccagaaagaaacagccggttctcctggaagaggccgacatggaacggctgggagccggttatgagagcggaccggaggagaagcttttgaaggaagagaaggcaaaactgatccgggaggtgctttcttccttaaatgccgacgacaggacgatcatcctgcttcgcgattatgaaaagatggcgtacgcggatattgccagagtgacagggctttcggaaaccgtggtaaaggtcaggcttcacagggccaggcttaagtaccggagccggtatgaacagagaggaggtgacagctgtggcatgtgattacagagatcgggtactggagtatctgcggggcaataccgaggacccggaagtggaaaagcacctggaggaatgcggagaatgccgcgcgctggtcgaggggtatctggagaaagggaaggagctggacataccggaggccggatatggcggtacggatgaggggcttaaggagcgggtggtccattttgaaaaaggaaccaggaggatcctggtgttcaccctggtgggattcgtgctgggctggttttccatcacttattttacggattcctttcttgtgacaaaggtgattctggccatcccgtacaaggccagtgagatgctgcacaatctgtttcatgcgcagccctacggctattacagcgggaacggcatgtttacggagttcaatgaattcttcccgggaagaggccttcttacgtttctggcggagcggattacgccggtcatgatcgggggcgctgtctatggcagcctcgcctattttaccggagattcgaagatctttacgctgcggcgctatctgaagtttgcagccgtctgggcggctgtagtccttctgtggacgggggcgctgttaaaggcggacaccgtaatggcggcaaaggatgaccgtatggaggacgtaaccggattctttctggcgaccgaaatccagggaaacggctactatgaagaggacgagccgggagggattgacaccattttccgcattcttcgggatgcactttaccaggacgggaatcccctggaacgcttaagccctgatgtgcgggtgcccgaggatgaactgcagcttcagatttttcttggaaaataccggcaggattccatgatctgcgaggtgaatccgaaggagcattatctggtgacggagcacggtacggtataccgggtgccggaagaattctccagatatatggttcagtaccaggaggactgtttggagtccttatatgatgaatacgacggggaggagacgatgacagatgaagaaactggcggaatggagaattaaaacgaagaaagactggatccttgcgttcctgtttacggccctgatggtctatgtggtggcagtccgcttttttcactggaagatcctcaattttatgcagaagttcatgccggataagatgagtaccatgaacctgccggagggatatggaacggtgctgttctgcgctttaggcatggcggtgatcacgatggcagtgcttgcgcttgagcaccagaaaaagaagtatatagcggcggcggggctggccggattcctgattgccgactgcgcgctgggcggcttcgtattacactgccgcctgatcgtacagcggggttatgaggaaccggcggcttccgcctggatcgccttacgtgatgagaatgagaatgtgaatctggcgtccggagacgagactctggcgcggcttcagatgctggcattttccctggagaggcagccggccgagagacaggcggagctaaaaaagctggtgagagaagggaagcaggcccgttcgtttgtctggttctcctttccggagaaatattttcacggatacgatcccatatttaatatagaagaaggactgatttatatggaccgcggggatcaaaatatggtgttttacaaggataacggtttcattgagtgcgtagaagaactgaaaaacaccatgattgagaaaaaatgattgaagaaatggtgatgactgccaataagaaaaatatcggctcccccagcttatcgtaaccactaaagtgtttcttttaccaaaacgttttaattgcacttgcttaacgagtgttccggtgctataattgagacgaacagggggtgcgtgatgaaaaaagtcagtattaaagatgttgctaaggaagctggagtatcaattactacggtttccagggcattgaacggttatatggatgtcagcgagaagacgagaaaacatatattagaggtggtggagcggctggattatgcgccggatttgaatgccagatctttgggaggcaaggcggatacaaccatagcgcttttaacgtcagaattgacgcccacgaacgaaagcggtttcgtttacggattgatcagcggtttatttcggcagtgcaatgatatgggctgtgagtttgtcctgctggctacgaatacgatgaaacagcagaagctgagctttcttcaactgtgcaagagaaagaatttaagcggcgtcgtggtcacgggactgaaggtggatgatccctattatcatgaaatcctggacagcgatattccctgtgctatcattgacatgccggtcagaggaaggaaaaagtgtgagattgcggtcgataatgtggcggcatccaaagaagcggcagcgtatctgatcgggctgggacacagaaatataggcatgattaatggcggaaaaacagcggatgtaagcggccagcggtattccggctatgtgtccgcactggtggaggcggggattcctctccaactggattatatgaagtactgcgatttcctggaggatacggcctgcgaaaagacggaagaacttttgacaaagtatccggaaattaccgctttgttctgcgccagcgatgtgatggcgatcggggcgatccgggcggttgagcagatgggaatgcgggttccggaagatatatcagtaatgggctttgatgatatccccattgctccctatgtctataaagggatatctacagttcggcagtcaccgttactcatgggaatcgagggggggaaggcaatctggaagatgttaagcggtgaagaggtagacagccgcgtgatcctccctcatgagatggtgatccgtgggacgaccggaaaggcgagagcctgattggaaaatataaaaaagtgccaaattttttatcgaaaaataggcactttttttatttacaaacaaggagagcagcgttataattaagtaacgaaaacgttttggaaaaaaacgctgtatgaagcggaagaataagagtcaggaggaaaatgcggatgaggaaaccgggatgcgtattaaggatattgtgtggcgtggtggatttcctgctcatcatgattccgattcagttcatcatgatgggtgttttctcggtatcactgaggcaggcggatctgctgtttaagctgctgtttgctgtgtatggagcactgctgacagagtatatgggaatgactgcaggcaagtatttcggaaaactcagagtcgccgataaccgcggaggaaaggcgcccatactctacgtgggtttgcgggaactgacgaagtctttgtatctgataccgtggctgggctgggggcttgcattggtcagccttgcgatgatggctgtccgcagggatggcagaacccttcatgatctggtcggcagcaccagggtgatgacggcgagacggtttgaacaggaggagagggagcgaatctatgaatggaatgactgagcattctctgctggcaatgactgatccggttttgcttatggtcagcgcggcagctatctgttttctgggttatttctgtgccagacggtttaagaatacaaatgattttgcaaagagtgtaaagttgtatttaccacttatggcagttgcggactgcatcatcgtatggggatggaacctggacattctgctgctggccgggatcgatatctgcggttttattgtaatggcattggcgtcaaattattatttctaccatggatcatgagtatatttttttacagtataacaaaaacgctttggtaaaatggctttaaataggaaaatcaggaggaaaatttttatgaagacaactatggattactcgaaggccgcagactggattataggcgagaaggcatttgacagccgtctgttggggaaatgcgagtcgataatgtgtctgggtaacggatatttctgtatccgcggcgctgcggaggaacggtatgtgcgggagaagcgggactgcttcgtggcagggacatttaacaaatttgatgaaaatgaagtgacggagctgcccaacgcggcggatctgatggcaatggatttagaactgaacgggcagccgtttactttagaacagggagagattaagttctattaccgccagttgaacttaaagacaggagaactgacgcggaccgtagactggttgtctccggatggagatgaataccggttcgtttttgagcggatcgtatccatgaaggaaaagcatgtggcggctcagaggatatcggttacgccggtgacccgggatacagatttcctgatgattacgggaatagacggcagcatgaacaacagcggtgtgcagcatttttctgaaggcgacaagcggttctatgaggggaaaatcatgcaggcctgtcagaccacgacacagtcgggaatcggatttgtgctgactgcgcaggcttcatttacacttaataaagaggcatatacgccaaaacagcatattgccatggaacggcggaaaatcttctgcgaatatcaggggactgttccggcaggtaagacgctggttatggagaaagtcggcaatatctatacgacgcgtgaccgggagatggagaagcgctctttaaaagaattgcaggaatatgcgcggaccgccttagagaacagcgcggaaaaagggtataaggccctggccgcagagagcgctgccatgtggatggagcgtgtctgggataagacgccgattcttatcgactgcgaggatcccatggatcagctggcaatccggtttgcccagtatcatctctatgtgatgacaccggctcatgataaccgcatgaatatcggcgccaaggggctcagcggagaaggttataagggacatactttctgggacacggatatctttgcccttccgtattttacgtatacagatccggaggtggctcgttctctggaggaataccgctatctctccctccctggcgctcataagaaggctgaggggaatcagtataagggggcccagtttccatgggaatccgcatggctggatgacggggaggtgacgcctgtctggggggcagcggatattattaccggactgccgaccaagatctggtccggctttatcgagcagcatatcacggcggatgtagcatacggcgtatggcagtattacatggtgactggcgaccaggattatatgaaccggtatggttatgagcttcttatggacacggcaatattctgggcttcccggctggaatggagtgaagaggaccggatgtatcacattaacgatgtggtgggcccggatgaatataaggagcatgccgatgacaatgcgtatacaaactatatggcgcactggaatctgggaatcgcaattacttattatgaggatttgaaagaacatcatatggatatttttgagcgcctgaatgcgaagatgggactggacgcggcctgcaggatctggagagaacgccgtcccctcatttacctgccgcagccgcgtaaggaggacttagtggtaccgcaggacgccaattatcttagctatccggttattgacttaaccaaatataaagagcgggcggaagtggggagcctgtttaaggattataacttagagacggtaaatcatatgcagatatccaaacaggcggatgtgatgatcctgttcctgctgatggaagatttgttttcaccggaggtgaaaaaggccaactgggattattatgagccgaagacgctgcatgattcctcattatctttgtccacccacgtgattctggcgagcgaccgaaaggataaggccttagcctatcaactgttttcacgcgctgtccggattgatgcgggagagaatatgaagtcttccaatgatggaatccatgctgcttcgatcgccggcatctggcagtctgtggtctacggcttcggcggcgtgcgcatgcttcacggaaagctgcgggtatgcccggcccttccggattcctggcataaactggattttgccattttctggcatggacagaggcttcatatggtgattgacaggaatacgctcacgattaccaatgaaaccggtacggaagctgtagaagtggaagtatatggtcagaattaccaaatcagggacagcattcatgttgaatatgccgaactgtaatatagtgcaaattaactcttgaaaacaaaaacgttttggtgtatattatgattatccaaaacgtttttgtaaatgaaatacatgttaaaaatgacgaagaaagtgacgcggtatacacagacaaaggaacaaaatggaaaagaaacagatcaatggaagaaggaagatggaggaagtatcatgagaaagagtatcaagaaggttttagcacttggaatcacagcggttatggccttatcactggcggcctgcggaggcggtacttccggaagtacccggacagacggcgcagacaagggagcagctcctgacagcgcggctgcgggaggcggttattcgggaaagaccttatccatcgggatctggggtggcaatgaccaggagtctgcggcgatcaatcaggtaaaggcggatttcgaagcgaagacaggcgcgaaggtggaggtcaaggtttatacagattacaacacgcagattcaggcggattttatcgccggcacggctccggacgcattttatattgatgcgattatgtttccgttctacagcgggctgggggtgttggagcctctcgatcctgtagagatgggaaccgacgcatattatgagaatctgctgtcggcctttacggcagaggatggcacggtctattgtattcccaaggatgtatcaacactggctacctattataatatcggtttgctggaatccgtgggagtcagcccggacgatataccggcatccttagaggattataaggacttcctggtggatttacagggaaagctggatgaaaaatacggcaagggccaggtagcggccatgacttacaatcaggatctggccaggaacatatacatactggaggctggcggctacagcgtctccgatgataatggcaatgcccggttaagcagcgacggtgtggtggacaacatgcagtttatggtggacctggcactgactggtgcctggaagacaccaacagatctgggtcttggctggaacggcgaggccttcggcgttggcaaggcggcgattatggaagaaggaaactgggtctataccactctgaaaaatgattacagcgatatcagatttggcgtgaaggggatgccgacctacaagggaactcagtactccatgtcctttacggttggctggggcgtatcctcagtatccaaggagaaagatcttgccagggaatggattcgatacgcggcaggtgaggaagggatgaagacctggtgtacgggagccggatgccttccctccagagccgatgtggcaacggccatggacgtggagagcgacccggtctggaaggtacattccgatatgatcaacgtagcgcttccgtggcagaagggaaccactatcgacatcatcaacagcgcatataagaattttattccggcggcgttcaagggagagcagtcaccgaaggaggttttggagcagatcgataagcaggcaaacagcgagatcgcaaacgcgatgtaacgcatagtggggagatggaatagtggagaaaatgaaaacagtaaaaaggtgttacagcggatatgagaaaagggagcatgtgcagggatacgtattcctgacaccggccatcatcatcttgtcggtcttcattggcttatcggtcctgtttgtcatctacctgtcctttcataaggtgaatttatttaccagaacctatgaatttgtggggctgcagaactataaaagggtctttactgatgatattgcgagaatcggtctgaagaataccctgatgttttcggtggtggtagtaccggtacagacaattatggcgctgatcatatcatcggtgttaaacagtaaaattaaagggaaatatttttttcggaccgtatatttccttccgacactcacctccagctctgcgctgaccatgatctttatgttcatgttcagcgtgagcggtcccatcaacggggcgctcttaaggctgcatgtggtagagcagggcatcaatttcctgcaggaaccggcatttgcactaaaggtcatcatggcgatgaatatctggtccacgattcccatgtatacaaccatgtacttagccagcttacaggatttaccggcttccatgtatgaggcagccgacatagacggggcggggcccgtcaaacgttttttgtacatcacggttccgtatttaaaaccgatcaccacgtatgtgctgctgacaagtatcattgggactctgcagatgtttgatcaggcatatattttttccaacgggtccggtggaccggccaactccacattaacggtatcattgatggtttacaaatatgcgttcggaacccagaacgccatgggctacgcagcaacgttagcgctgatccttgcagttatcatcatggtcatttcgatgttagcggaaaaggccaacagtgaagagcgagtctattaagggggcgaaaatatgaaaaaacacatgaaacccggaatgattggtttgtatgcgattcttatcctggcggcggtcataacggtatatccgtttctgtggatggtatcggcgtcatttaaaccgttaaaagagatcgttggcggcaatcttgcactgatttccgagcagatgtcatttgacaactacaagtatatctttggccgctcctccttatttccgagatggttcgtaaactccctgatcatctcggtgatcggaaccgcggtgaatgtcttcatcaataccatggccggatattctttatcgcggctgtcgtttccaggcagggataccatttatcatctctttctggccctgatgatggtgccggcgcaggtccttttgattccaaactatctgatattacagaaaatgggactgctggacagctattcgtccttaattcttccggcggcggccaatatcggcaacatttttctgatgaggcagtttttcatgaacttcccgaaggaagtggaagaggcggccagcatcgacgggttggggcgttatgccagattcttccggatctgcatgcctttagccaggccgacgatcgctacccaggcgatcttcgtgttcatgggcttctggaatgagtttaccaagcccatgctctatatcaagacagcatccaaatatacgctgaccctggggcttcagagttttcagtcccagaacgcagggaccatgtggaaccaggtgatggcggcggcctgcatctcggttttcccaatcatcattatttacttgatttttaataaatattttctggtaggagtacgaatggatggagaaaaatagtttaaaagcagtgatttttgatttggacggcgtgatcacggattcagcgaagtaccactatctggcgtggaaggaactggcggacgaactggggattccttttgatgaggaatataatgagaaactgaagggtgtgtccaggatggagagcctggagttaatccttgcaaatggccatggaagagtctggagcgaggaagaaaaggtccggatggcggagaaaaagaatgataactataaggaactgatcaaacagatcactccggctgacttactgccggggatagaggaatttttgcaggaactcagagataacggcatccgcatcgcactggcatctgtcagcaaaaatgctccgtttatcctgcatcaactggaactggaggaatacttcgactatgtggcagatgcagcgaaggtggaacatgccaaaccgtttccagacatcttcctggcaggcatgaacgcgtttggcctgcggccggaggaatgcgtggggatcgaagacgccagaaccgggatcgaggcgatccatcgcgcgggcatgaaggcagtgggagtggggacaccgtcggagatggaagaggcggactttatcacggatacggcgcatttgcggctggatgtggtgaggcgaatcgtggattaggaaaacaggaatcctgtgatgttcttatattgatctgtgccgcggagacaatcgatacaatgaaagataggagaaaatgcatgaatgagaagacatggtggaaagaaagcatagtgtatcagatttatcccaggagttttcaggacagcgatggagacgggcttggagatttaaatggaattaccagccgaatggagtatctgaagcagctggggattaatgtgatctggctttctccagtctatgagtcgccctgtgacgataacggttacgatatcagtaattatcgggagattttaacggatttcggtacgatggaggactatgaccggatgcttttaaaggctcatgagtgcggcatccgtattgtcatggacctggtggtgaaccacacgtcagacgagcatccgtggtttgtggagagcagaaaatccgtggaaaacccataccgggatttctatatctggcgggagggaagggaccggaaagagccgaacaactggggttcctgtttctccggctccgcctggcagtgggatgaggagacgaggatgtattatcttcatttgttttcaaagaaacagccggatttaaactgggataatcccagggtgcgggaggaagtctatgatatgatgcgtttctggtgtgagaaaggtattgacggattccgcatggacgttatcagtatgatctccaaggacgaccatttcccggatggagaagtgggaccggacggatacggtgatttcagtccttatgtacgcaacggccctcatgtccacgaatatttaaaggagatgaatcgggaagtcttatcaaaatatgatctgctgaccgtaggggagtgctccggtgtcactatagaggaggcaaaacggtatgcgtccgcagacggcacggaacttgacatggtattccagtttgagcatatggacttagacggcggtgaaacctttaaatggaacgaccgcaggattgatttggtggagttgaaagcagtattatcgaaatggcaggtggaattggatggaaaagcctggaacagtctgtactggtgcaatcatgaccagccgcggatgctctcccgtctggggaataccagctcttcttaccgggagacgtctgccaaaatgctggcgttatgcctgcatatgatgcagggcaccccctatgtgtatcagggagaggaactggggatgaccaacgcaccctttgaggaactggaggatttccgagatattgaaagtataaacgcctatcatcagtatgtggaaaacgggagatttgatcatgataccatgatgcggtatttgcggtataagagccgggacaacgccaggacgcccatgcagtgggatgacacggaaaacgcgggatttacaaaggggattccctggataatggtgaaccctaactatcgggagattaacgcagcggatcagatggcgcggccggattccgtatttcatttctatcagaagctgatccggcttcggaaggaacatgagatcgtggtatacggccattatgaactgctgatgccggatgacccggaactctatgtgtataccagggagtggaacggggagatgctgctggtggtttgtaatttctttgacaacgaaagaagatttgtatttccggaagggctggatgcgaagaaggccgaattgtggattggaaactatccggaagcacaggaggctgatgatatggtgctgcgggcatatgaggcgatggtattttactttggtacgcagaagagaaacagggctgaaggaaccatttatggttaaattataaatgtgagtaggacgcgaaggctgaactgttgcgcgttttgcgcagatgcagtgtctccggcttgactttacaggcggtttgtgacaaaataggtagttgtagtgaatgaaaaacctggaaagaaaagaggtccttaaacgatatgacaaagattgatattatatccggcttccttggagccggtaagacgacttttattaaaaaactgctggaggaggccatctccggtgagcaggtggttttaattgaaaatgagttcggggagatcggcatcgacggcggattcttaaaggattccggaatcgagatccgtgagatgaacagcggctgcatctgctgctccctggtcggtgattttggaaagtccctggcggaagtgctgaccaagtacaagccggaccgtgtgatcatcgagccgtcaggcgtgggcaagctttctgacgtcatgaaggcggtcagagatgtggcggcggagatcgaggttaccttgaacagcgcggttaccatcgtggatgtggcgaaatgccggatgtatatgaagaatttcggtgagttctttaataatcagatcgagaacgcgggaacggttgttttaagccgtaccgacattactgccatggacaaggtaaaccaggcggtggaactgatccgtgagaagaatccgaaggccgtgatcgttacaacgccatgcggccagttaagcggcgcccagcttctggaaatcatcgagaagccggatacgatggcggaagacttaatgaaggaagttgaggagcaccgtcatcaccatcacgaccatgacggcggggcgtgcggctgcgggcatgatgaggaagcgtgcggctgtggccatgaccatgagcaccaccaccatcacgaccacgatcatgaagcagaggagtgcggctgcggccatgaccacgagcaccaccaccatcacgaccacgatcatgaagcagaagagtgtggctgcggccatgaccatgagcaccaccaccatcacgaccacgatcatgaagcagaagagtgtggctgcggccatgaccatgagcaccaccaccatcacgacggcgatcatgaagcagaggagtgcggctgcggccatgaccacgagcaccaccaccaccaccatcacgaccacgatcatgaagcagaggagtgcggctgcggccacgaccaccatcatcaccatgacggcgaggcctgcagctgcggtcacgatcacgatcaccaccatgcggacgaggtattcaccagctggggccttgagaatgttgcggccatgaagagggaagacttagaccggattctggacgaactggcatacggtgaccagtacggcgaggtgcttcgcgccaagggcatggttcctggagagaaagagggaagctggctctatttcgaccttgtaccggagcagtatgagatccgtgacggatcaccggaatataccggcaaggtatgcgtgatcggcgcaaagctgaaagaagacgaattaaagaaagcgtttggcaggtgagaagatggagtacacggatacattagatgacgattttatgccggtgtttctgatcaatggatttttagaagccggtaagacccagtttctccagttcaccatgcagcaggattattttcagaccgatggaaagaccctgctgatcgtctgcgaagacggtgatacagagtacgatacagaactgttgaaacgcaccaaaacggcaggtatattcatcgagagcatggacgagcttacgccggagcgtcttctggagctggagcttctctataatccggagcgcgtcttaattgagtggaacggcatgtggaatcaggatgacttacagctgccggacgactggcgtgtatatcagcagattaccattattgacatgtccacctttgacttatatgtggctaatatgaagcctctgctgtatgccatgattaagaattctgaactggttatctgtaaccggtgtgacgggatcgaagatttatcaggctaccgcaggacccttaaatccatgtgccagagaggcgagattgtctttgaggattcagagggagagatcgacgagatcgcggacgaggatctgccttacgatatgagtgcggacgtgattgcaatttcgccggaggcctacggcatctggtatattgactgtatggacaggcgggaccgctacgaaggaaagattgtggaatttacggccatggtattaaagagcccggaattcccgaaaaattactttgtcccgggacgtatggccatgacctgctgtgaagccgacatgacgttcctcggatttgtcacgaaggccagagaagcgaaggacttacagacgaagcagtgggtaaaggtccgggccaggatcgcctacgaattctggaaggactatgagggcgaaggccctgtgctctatgcggagtccgtccagccggcggagcccatccgggacgtggtacagttttaacaaaacaagcttaacggcagtggcgggcggagagaaatcggtatcccccactgacatgaagtcaagccgcgcatctataagaggtagtcgcactctgtgaaatgatcgagcgtggattgaaacaactaaacaaagatcgggcaggccgtctcagcgccatatttccttcgtgcggagtgtcggcccccggagggtttttgtctcataggacagctttcctatgaaataaaaaaagagccttgaggcggaactgtcatggtcccgcttcaaggctcttttgagtttgcagtgttttgtaatgaatgataaagctacatctgtggtaccggtgtcggcctggccggatcgaatacgtccgggacgctgaacaagtcgcttaagctgtccggatagtaatacatgcggtagccatccagattccgtctgccctggcggaaatggtccggtcccagctgcatccagtaaggcgtgctggcatccacgttgcagaaatatcggaatcccagtgattttaaataggtaaagcgttcattatcatccgtataaggcttccaggtcccgatatcgctgccaaaggggtagagaatgatatcggtaggaccgatcagggattccacgttcttttcccatttatccgcgtccagcctgaagtgttccatggagatcgtgcccaggttgcggtggccccagctgtgggaagccagttcccagccgtggtctctcaggcactgtgcgactgcggccgcctgtttgcggtcctcctcgtaattgggattggtgtccttataagattcatctgtccggtatccaagaattccattgtagcccgtaaatgcgataatggctcttgcgcccttataagaaaatcccgggtgttctttaatgaaggtttccagtatgggaacgagatcaaaatctccggtgacgacgcttccgtcatcctgttccatctctgtggtgggatagccgtcttccccgatcaccatgcgggtggcgaagccgtctcccttcatatattcatagtagcacacgtcatcctgtgacatgacgaaggcctttttcccttcgggaagcatgatgtcgccgtagacgaacttcggattgccgttttcgtctgtcgtctcataggcgagatcgtggatctttacgaggacgtagcccttatcgtacatggactgcatcatcttgataaactcgtctttcgtcgtcatcatctgattgtatccgccctcccggttgtctccgtcgaaggccttggaggtatcgacgatcagagagtggaagaacacatgggtgacttcctggggattgacgcggaccagccggctcatctgatccgtgtaggcggcgacggcatctgcggcttccttcgcggaggcgtagcggctgtcggaggtgatcagattgatggcgccttcataatcgtactgcagggccaggctttccgcctgtgtaaggagatcgatcaggccggtgtcctctgtctccggcgccgtggtgatgacctccggaggggatgcctccgccgtggtctgggtaacggatgccttgatcgcccccagccccttgcgttgccggcccagtataatgccgcccgtgactaaggcggcaaccagtaaaattcctatcataatgacaatgatattatgtaacgtgcggcggcgcttttcctgctgacgccgttcacggtattcttccatattcatgcgataacctctttttccagtgtattgaaggagctctgggcggccggatcagacagatgcttcacagaaagtttcacactgctgtacccaaaaccggcccggataccggacacagtacaaactcctgaatcagtataccatactttcagacaggatgaaatcgtatcaagggaaaattaaggaaaaatttttggcaaaaagtggcataggaatggaaatcccacccatacaatgaaacaaaggattttatcaggggaaattatgaaacgattgttagctcttgttttaagcatgctgcttttcctctgtccgtctcatgccgcgtgggggcaggagccggacattgccgtggcgtcggacatggtaatccggtcggaagaggcgaagactgtaaacgccgagggaggtccatccatacaggcgcccagcgctctgctgatggaagcttctaccggacaggtaatatacgaaaaagatgcggatacgaaaaggagtcccgccagcattacgaaaatcatgactctgatcctgatttttgatgccctggattccggaaaaataaaaatgaccgacgaggtggtcaccagcgcacatgccaagtccatgggcggctcccaggttttcctggaagagggggagacccagacggtggaaaccatgatcaaatgcatcgtggtggcctcaggaaacgacgcttccgtggccatggcggaatacatagctggaacagaggaagaatttgtgaaaatgatgaacgagagggcggccggacttggcatgaccaacacccattttgaggactgctgcggcctgaccgattcgcctacccatgtgacgacggccagagacatcgccctcatgtcgagagaactgatcaacaagtatccccagatccataattactccaccatctggatggagaacatcacccacgtgacgaaacagggaacgaaggagtttggtctctccaacacgaataagctgttaaaaatggcgaccaacttcaatgtgaccggtttgaagacgggttctacgtctctggctaaatactgtctgtcggcgaccgcagaaaaagacggtgtccgcctgatcgcttccattatggcggctcctgattacaaggccagatttgcagacgcccagacgctgctgaactacggctacgcaaactgccgcctgtacgaggataaggagatgcttccgcttccggagctggtggtggataacggcgtcgtggacagcgtccccttaaaatacggcggcaccttctcctatctgagcttaaacggggaagacctggctgccatagagaaggaactggtactgccggaatccatagcggcgccggtggaggaaggccagagcgtgggcgtgatcaaatacagcctggcgggaaagaagctgggagaggttccggtactcacggctggagcggtgaaggaagccgggttcatggattactttaagagagtgctggcgggattcgcagtttgacagcgcggcgccggaaagaaaacgaaaaacgggaggaaaagcgtctcatgcttttcctcccgttttttatagaagccctccaaactgtaagaacagcggagcgaataccagggatacaatggtcatcagcttgatcaggatattgatagatggtcccgacgtatccttgaacggatcgcctaccgtgtcgccgacgacagccgccttgtgcgcggagctgccctttccgccgtggttgcctgtctcgatgtatttcttcgcgttatcccaggcgccgcctgcgttggacatgaagatggcggtgagaacaccggtcaccagggctccggtcaggagtccgcccagggcttccggcccgagaatcagcccgacggccagagggacgagcacggccatgaggccgggaagaaacatttcgcggagcgcggcagtggtggagatggatacgcaggaggcgtagtccggccggtcggtcccttccaggatgcccggcttctcgtggaactgcctgcgcacttcctcgatcatctggtgagccgccttcgacacggattccatggtcatggaagagaagaggaaggtgagcattccgccgatgaacagtccgacgatcacatgagcatttaaaatatcaatcgtttttaaatttactgcttccgcataggagacgaacagggccagggcggttaaggcggcggaaccgatggcaaagccctttccgatggccgccgtggtgttgccgacagagtccagcctgtcggtgatttcgcggaccgaatcatcgagaccggccatctccgcgatgccgccggcgttatctgcgataggaccgtatgcgtcgatggcgacggtaatgccggtggtggaaagcatgccgaccgcggccagggcgattccgtagaggcccatcaggcggaaggagacgagaatgccgatgcagaccagcaggatcggaatcgcggtggactgcataccaacggcaattccgctgatcacggtggtagcggacccggtctcagactgtttggcaatctttttcacaaaacgatagtcgccggaggtgtagatctccgtgacgaatccgatcataacgcccacaaggagtccggcgatgatggcaaaggcggcgttgaagctgccgaaatatatgtagcttaagaggaaggaggcggccacgaccagggctgtggcgctgtactctccgctctttaacgcacggtgcggattggaattgttgccggctctcacgatcagggctccgatgatggacgccacgactccgcaggcggagagcagcagcgggaagatgacacccgcttcctggtagaatacgacacccagcgtcagcgctgagatcagggatcctacatacgactcgaacaagtcagcccccataccggccacgtcgcccacgttatcgcctacgttgtctgcgatgacggccgggttccggggatcatcctcaggaattccggcttccaccttgccgactaaatcggcgcccacatcggccgccttggtgtagattccgccgcccacacgggcgaataaggcgatggaggaggcgccgaggctgaagcctgcaagcacttccacatcctttgtaataaggaaaagcgttccgacaccgagaagtcccagtccgacgacggccatacccataacacttccgccggaaaacgccacggataaggcccggctcataccggaggtccttgcggcgttggcggtacggcagttggcgcggatcgccgcgctcatgcccagataaccggcgatggtggagaaggcgctgcccaccaggaagcagacggccgtagtccagcttctcgtaccaaagccgatcacgacgaagaggacagcgacaaagatgatgaggacacggtattccgcggtcataaatgcccttgcaccttccgcgatcgcgtccgcaatctcgcgcatccggtcatttcccgggtcctgcttaatcacgtgaagacgcagaaagatggcgaacaaaaggccgatcaggccgataacgggtacagacagtatcattttttccataataaccctcccaattttcatgatatttgtgcaaattgatacctgtgtaaaccattgtagcagataaactgcgagaatacaacaaaaagttttagataacctaaaaataatttagaataatttattctgcaatttagttgacaaacaatattatacgatatataatataaccatactatacaagatataatatagaacacaaaataatattatactaaacaataagagaaaggtcgagtgagtatggagacgaaacgtttataccgatcagtaaagaataaggtgatttgcggcgtgtgcggcggcatcggagagtattttaatgtggacccggttattataaggcttatatgggtaattctgatgttcttccagccatggcgtcatatgttccattcgtttgcgggattttccctcatcggcggcagcttggtcgtttatttcatcgcggcagtgatcataccgcgggcaccctcagatgacggaagccgttaaaggccgttcgggagttactgttcacggccagtatcccgcgaggtgttttttgtgagtgcagcgaagcgaaagtcacagaaaacccgagggtagcagcgcgaaacggtgtttttgccgtttctgtgcatcgcgaagcgtgttgctggtcacggagtgaacagtaacgttcggatctgactgaatgagaagataggagtgggaatatggtttttaacacaggtgcagccctccttgatgcgatcgtactggcggttgtgtcaaaggaacaggaagggacttacggatataaaatcacacaggatgtgaggagtgtcatcgacatttcggaatcgaccctttacccggtgcttcgcaggcttcagaaggaagagtgcctggaagtctacgatatggctatcgacggcagaaaccgcagatattataagattacggaaaagggcagagtacagctaaatttgtacaaaggtgagtgggcaggctactcccggaagatatctcaaatctttgaggaggcattaatatgaacagggaagagtttatgaaggagctggaatatctgctttccgatattccggatgaagataaggcggaggccatcggctactacagagattatctggaggaagccggagatgagaatgaggaagcggctatcaaggaatttggaagcccggagcgcatcgcggcgattatccgttccgatctgtccgggcatttggaagacggcggagagttcacggagaaagggtatcaggatgaacggttccgcgacccgaattaccaggtggcgaagcggtatgacctgccggacgctgtggaaggacagaagacagaggaacatgaggaaaagagagagaatcagccgagaaccaaccggacagtgaagatcatcctgtggattatcttaatcattgtggcgtccccggtcctgtttggaatcggcggcgggatggtcgggatgttcggcggcctcttcggactgctggtagcggctgtagtgctcgtgggcgtccttaccggagtgctgtttatctgtgggattgcactgctcatagtgggcatcgtgtcgatggtgattcatcccttaagcgggatactggttatcggcatttccgtactgacgctgggatttgcctttgcatgtctggctttatgcggagtgttttacggtaagtttctgccgtttctgttccggtcgattgtgaacggaatcagtggtttactctatggaaggaggagtcgctcatgaagaattttacgaaggcatgcctgatagcaggcggcgtctgcattctgatcggaggtgggattaccactgtggcggccgccatgggcggcagactgtcggatgtgtctgcttaccattacagctggctcggccatgatatcgccgacggcattacccgtgacatcaggtcggggatggacgatttaagccgcgacctgtcggataatttcgacgacagctttgacgagctgggccgcgaatttgatgatatcggccgcagcatccatgacagactggatgatggggaattaaacgagagtacattttctgagatctacgccaggaagctggatctggaggttcgaagaggaaaggccgttatagtatatgatgctccggcggatgagattgttgtctccagtgaggaagatatggcgcgctggaaggtctacagcgaagaggatgaactgaaggtaacggttgggtccaaatcctgggattcccatgattataaagatacggtgatctatatccacgttccggcagattaccgtttcgaggaggtcgaactgaaggtcaaggcccagagtaacaacaagataatcaacagcgatgatggtcctgccattgtggcggagggcttgaaggccggcaagatagagatcgatgcatctgtcggcgcagtaagagtgaccggagccgacacgggaaagctggaggttgattccgatgtgggagctgtgcagtttgaaggatcggtagacggcgatgtggacacggaatgcagcgtcggcgctgttaaactcgacctggcgggagcgaaggcagattttaactacgagatcaagtgcaaggtaggcagcattactgttggcggcgagggcttttccggtctgtccagggaaagaaagatcaataacggggcagccaaaaagatggaactggactgcaacacaggcgcgattgaagttaaatttcactaattcaatggaaaacatagagagaacagagaggagattcgaagatggatgacagagagacaagaagattatatcgttctgatacagataagatgatttgcggcgtatgcggaggaatcggtgagtattttaacgttgatgccacgctgatccggctcttatgggcggtgctggcctgttccggcacgggcgttgtggcctatttcatcgcggcgatcattattccccgcagataggaattacgcggatacgattaccattctggctccggctgcttttgcggcctggagctttttttcatttcatgggaacgttcgtcccatgatataaaaaccctccgggggatgcgcactccgcaataaagaaatatggccgctgaagcggccgcgctccggcacgagagtccggcttgccggactctttattctaaaatgaaccattttatcacctggaggctcttatatacaggtgcaccaaaaacggaagggagagaagcgatgaacgaaactgaaatcgtaatacagatgcagcagggtaaggaagaggcgtttgacctcctgtttgatatgtataagaataaagcgtttcggctggcgtatcttatttccggcagttacacagacagtgaggatattattcaggaggcatttgtaacatgctatgtgaacaggaagcagctgaaggaacccgcctgtttttcgaaatggctgtatcagatcatcacgaggtcggcatggcggtactgcaggaagcggaaaaaggaacagccggtggaggaggtctttgacgagtttaaggaagacccgtccgaggcgccctgcgaacaggtgatccggcaggaagaaaaggaccgggtctatgaggccgtatgcgctctggacagaaagcagaagaccgtggtcatcttttattactatcagcagctgacgacgagagagatcgcggatattctgggctgtatggaaggaacggttaaatcgcggctacatacggccaggaaaaaactttcaaaggctcttgaagacatgggatggcaagaggaggagaaaatatggacgaaaaaaaactggattctctgatcacggatacacttgttgagagggcagagcgcctttctgtatctcctgaagtaaagcagcttgtgagacagaaaatttctgagggaaaaaaggagaaaacgaatatgaaacatcggatcagcggaaaaatagtaattctggcggcggccctgtgcctgcttggaaccatgggtgcggtggcggcaggaagggcagctggacttgtcagccattccaataggaacgatccggtctatggaagctacggggaactgagaagtaatgtgaagcaggatctgggatattccgtaaaaacggtggagtcgctgggagaaggatgggatttccggagggcttccattgggagcgtgcaggctcaggatgagacgggaaatgtgatcggcacgtatctgaacctgaaggtctgttacggcgcctctaagaaggaggaggtcagcctgatcgtcagacggccgggaagccttgtcagcgaagatgtgaggcagcctgacgcggcaggggaacacgagggaatcgaactccgctattactgtgacaggtacaaattccttccggttggaaccgagatatcagaggaagacaggctggccgaggaacggggagaactgttcctttcctatgggtccgatcagacagagataaacgattactataccgtatcgtggaaggacgatggaatcagctactccatcatgtccttggatcggagctttactgcagatgagatgtttgcaatggcggcggaagtcattgatgggaaataatcgtagtttccctgtctgccgcagcgcctgacggttcggggttcagcaggacggaagtctcaaagactccgtcttcataccggaaccgggcgatgccgtggtactggtctgcgatgtggcgtacagacatggtaccgatgccttccccggcgtgatgggaggagaggaagactccgttctcttcccggatctccccggagtaggagttgaccacagacagtgtgaccatggagcggcccgccattcccagcttcatgcggataaagcgttccccttccgtctgttggaggcatgcatccacggcattggacagtaaattccccagtatggtgcagaagtctacctcgggaactgtcagaagagagggaagctggatctcgatggagacggcaaccccgctgctgacggctgtgttttcataatagctgatgatggaattgaccgcatgattgtcacagtactgtttcagggcgtagctgtcggtctgctttaaaaactcttcaatgtagcggaggcatccctcatagtcccggcgctcggcgtatccccgcatggccagcagatggtggcggagatcgtgacgggccttccgggttccctcaatgttgtcctgcagaaggctgtactgctttttctccatctctgtcagcagttcggcggtgtgaagcttttcccgcagaacgatgttctgggaagtctccgacagcagccggaagatgcagagctggcagaaaaacatacccggataccagaccaggggaaacagcagcatggaattcttatttccggtctcaatggcggtatagtacggattgaagccgagccggtagagaaagaaaaaggacacgggaataatccataaatagttccagatattcatgttttttgtgctggcgatggccggatggatacacaccttgaagaagtggtagagtaccggtacgaggagaatatagacggtcagacggcacaaaaaaacggtggcggtctggctgccggaaaaggaagctgaatgccagatcacactcaccaggtcggagatcatattggttccatccagatagttgcgcgccgcaaacaccatgaagatggtgacgaatatactttcgcgaaaaagccaggacagaaagaggatgataactgccagacagtagatggaatataaggtcttaaatgagtctccgcccccaaacagggggcggagcagaaagtaagaaccggtcgtaacaaagaataaaagaaccagaataaaaaagctccatacgccgtttacccgtaaacggccccggaagaacagcaggatacagaaaataatcgtcaaaagttcgagcccgacggataagacggaaaaagggaactccattatacgcctccgctcagccgcagaaactgatagtccgcgtagcgctggtgaatttcctgacggttcttccgcgtaatcggcacccgctcatcggtatccatgataaagtcattcttttctaaagaaatcacccggtccatgttgacgatgcagtttctgtaacagcagagaaactggggataacagagaagatagggtgaaaatgtctcaaatttcatgtaggaacggatcgttctcgttttggtgtgaatctgaatatagtgattaaagtaatctgtaaatataatatcatcgagccggatcttaatcatggtccggctttccttgacttctatgtaccgcgcgtggctgcgcatggaccgttcgcagtattttaacgtgtctttaaatttctcataggaaaagggctttacaagataatcagaaacccgcagttcaaatcccctgaccgcaaagtcactgctgttggtagtaaagaccatcaggcagtccgcatcgctgtttcttaccttctccgcgatctccagtccatttattccatctaaaaaaatgtcgataaaaagcagatcataagcccccggcctccagcattccataaactgttcaccgttttcaaataggtcgacctgcctgtatatgggatttcctgaataatattccttaatatagccggataactgttccctctgtgctgaagagtcatctatgactgcaatacgcaatgttatcactctccttcgttcatatagcatacctttaaaattatatcatattatcgacagacctgctggaaattttgggtaaaaacagggtaaatacagtaaactatggtatattttggtaaaatgtgtcattggtgctgtcgaaaactggcacacggagccgccgccccatcctgcaaatcagaaaaccctccggtccggatgtttaaggggtctcataacgggcatactctccttagattcgagaaaggagcaagcctgtaatcatgtcaaaaggaaaaaagaacgaaccattcgatcctcacaatttaaaaccagaggaaatacttaaattcgaaattgccacggagttaggtctcagtgacaaagtaatcaacggcggctggcgttccctcaccgcgaaagaaagcggccgcatcggcggtctcattacgaaacgcaaacgtgaattgaaacaagaggctttagaagaaaagtaagaactgcgccacagcgcttaaggagaggggaagggagaccggagctgacaaacagacggtttcccctcccctctcctcaagctatgtggctaagaattggatttgtaaggggaaaagccataggggctcctgtttaaaaaaacttgccacccccctcgctatccattataatatacgggaaagaggaaacagcgatggaagagaaaaaattgagaagtggttttaccacgggtacgtgtgcggcctgtgcggcgaaggctgctgcggtcatgctgctgcagcgggaagcggtggagtgtgtccaggtgatgacgccgggaggaacgagagcggagctgttgctgcatgatgcggaacggacagagcgttcggccatgtgcgccgtcagaaaagacgcgggagatgacccggatgtgacggatcaggctttgatttatgcttcggtagagtacataaaagacagcggtgacccggagaggtgttaccggaacaatcatattttcttaaccggaggccctggagtcgggattgtgacgaagccgggccttgcgtgtcctgtggggcttcatgccatcaatccggtaccgagaaagatgatctttgaagaagtggaggcggtggcgcgaagcgcaggctgcgaaggacgcctccttgtccgaatatggattccggagggcgcgcgtctggctctcagcacctttaacccaaagcttggaatcgagggcgggatctctgtgctcggaaccagcgggatcgtggagccgatgagcgaggccgctttaagggccaccattcagctggaactccatatgaaggccgtggcagggcagcgggaagtgatcttaacacccggaaattacggggagaattttttgaaggagacgttaaatctctccctggcccagggggtccagtgcagcaatttcgtacaggattccgtgaaaatggcggcggacgaggggatgaacggtcttctttttgtcggccacgtcggaaaactgatcaaggtggccggcggtgtcggaaatacgcattcgaagtacggggacaggcgtatggaaattatgtgggactgtgcccggatacactgtgaggagatggcggagagtgacaggaaccggttgaaagaccaggtgctcgcatccaatacgacggaggaggcggtaatctggctggaaaaggccggagtcctgaaaccggcgatgatgactgcggtggaacggatgaagcagtacgtagaagagtggagcgggagaaccgtgtgcgccgaggtggtgacatttacgaacggatacggtatacttggtatgacctgcggggcagagaatatgattgaggcatttcgcattcgggaagaagcaaacgaaatgcagaaagaatagaagagagaacaagaacagagaacaagaacaggagagacaagcatgtctggaatactatacggaatcggagtcggtccgggagacccggaattaatgaccataaaagcagcaaagcggataaaggaatgtgcggtgatcgccattccacacagggaaaaggagctgtgtacggcctaccagatcgcgtgtcaggcggtgccggagattgaggagaaagagtgcctctacctccccatgccgatgacaaaggataaaaaggtgctggatgaaagccatgatctggcggccggcgctgtgatggaacggctggacagaggggaggacgtgggcttcatcacgctgggtgatgtgaacatctactcgacctgcagctatctgctggagcgcctgtggagtaaagggtatgcgacgaggctggaatgcgggattccctccttttcagcggcggcggccaggcttggcatgccgctggtgtccggagcggaggagctgcatgtgataccggctacgtaccaggtgaaggaagcacttaagctttcaggcgtcaaggtgcttatgaagacgggaaaacagatgaaggcagtcaaggaagagatccgcaaatgcggggccagtgccgttatggtggaaaactgcggcatggacgatgaacggatttttatgtccctggaggaaattccggatgagccgggatattattcactgttgattgtgaggtagagatggtacatatcgtaggagcaggtccgggagcaccggatcttattaccgtccgtgggaaggaactgatctcacaggcggatacaatcatttacgcaggctcgctggtaaatccggcgctgctggaatacagaaaagaaggctgccgcgtgttaaacagcgcgtatatgacgctctatcaggtggtagaggcggtccgtgagaccgaggcagagggaaagatgactgtccgcctgcacacgggggacccctgcatctatggggcgatccgggaacagatggatgaatttgaccgtttggggatctcctatcaagtctgcccgggagtcagctccttctgtggagccgccgcagccttgaatatggaatacacgcttccggagatatcccagagcgtggtgatcaccaggatggcagggcggactccggttccggagcgggaatccatcgcttcatttgcggcgcatggggcgaccatggtcctgttcttaagctcaggcatggtggcagagctggcggatgagctgatgcgcggcggatacggcgcggacactccggcagccatcgtttaccgggctacctgggatgatgagaagaaggtcgtctgcacggtgggaacgctggcagagcgggcggccggggagcagatcaggaagacagccctgatcatcgtgggaaacgcggtgagccagagcgggtatgccctttcgaagctgtatgattcgggatttacgacggaatacaggcagggaagtgattctgaggaggcacagaaagagaggaaatgatgaggctttcgctgatttgttttacaggagcgggggcgaagcttggcgcccggctgttgaaggaactgaaactcagcggccatgaatgccgcgggtacgtgctggagaagtttttgaacccgtttcacgagacaaatggtctggaacccttaaaatccagccttcaggaatggaccgggaaccagtttgagacgcgggaggggctgattttcatcggggccgcagggatcgccgtcagggccattgcaccgtgggtaaaggacaagaggacagatccggccgttgtggtcatcgatgatagcggccgcttttccatttcccttctgtccggccatttgggaggagccaacgggctggcggaagagacggcgaagctgacgggaggaatcgccgtcatcaccacagccacggatatccatggccgctttgcggtggataattttgcaaaggagcaggggctttggatctcggatatgaagacggcaaaggcggtgtccgccgatgtcctggccggtgagccggtgggatttttcagcgatttccccgcagcgggaagcgtaccggagggctttacccagaaggaaagctgtaaaagaaatgtctggattacggtgaagcgttatccggagaaccatgactttctgaagctgttcctgccggaaggcggggaggtgctccgtctggtaccgcggattgtaatcctgggaatcggctgtaagaagggcacggaaaaagaaagaatagaagcagccgtggaggaggcattaagccggtggaacatcgagccggagagtgcggccgccgtggcgacaatcgatataaagaaagaggaagccggactcctttcctatgtaagggagcatggcctatcctttcaaacgtatccggccgaacggctgctgcaggcggagggggaattctccccgtcttcttttgttaaggagatcacaggcgtggataacgtctgcgagcgggccgccgtaagccttgtagaggacttaggcggaggaagactgatgatgagaaaacaggcgggcggcggcgtcacggtggcggccgcggtccgggattggaaggtgaagctgtgaagcagacaggaaaattatatgtggtgggaatcggaccgggttcctacgaacagatgacgataaaggcggttcgcgctatggaagagagccaggtggtggtcggctatacggtgtatgcggatttgatgcgggaacattttcccggaaaagagtggatcaccacgcccatgaggcaggagacagaacggtgccgtatggcaatcgagaaggcggaggccggcatgacggtggcgctgatctgcagcggggacgccggtgtgtacggaatgagcggccttattctggagctggtgggagaatcggattccccgatcgtggaggtgattcccggagtgacggcggcgttaagcggcggcgccttgctcggcgcgcctctggggcacgattttgccgtgatcagcttaagcgatttactgactccgatggagctgatcgaggacaggcttttgcacgcggcaaaggcggatctggccatatgcctctataatccctccagccggaagcggtcggattacttaagacgggcgtgtgacatcatgctcaccgccaagaagccggaaacggtctgcggcattgcaaagaatatcggccgggaaggggagtccatggagcttatgacgctttccgaattaagggatacatccactgacatgtttaccaccgtgttcatcggcaatgagaagacaaaggcggtaaacgggaggatggtaacgccgagaggataccggaatgtgtaggattttaatcttcggaggcactacggaaggccgtcttcttgccgaatactgccaccagcaggaaatagaggcgtacgtcagcgttgtcagcggttacggtgcggacctgctgccggaaagtgaatatctccatgtgctttcgggccgcatggccggggaggcgatggaaggcttcatgaagcgggcagccatccgcgctgtctttgacgcgacccatccgtatgccgcggaggcaaccagaaatataaaggaagcctgcggccgcgccagggtctcctatctgcgggtgacgcgggagtctgctgcagcggagaatcctggaggtgacagcggcaaaggcccagccgcagcatttgcatctcaagtcgtatacgtgtattccgtagaggaagccgtctgttacttgaaggacagggagggagacatcctcgtgactacggggagcaaggaacttgccgcctatacagcgcttccgggatatgaggaaaggctttacgtgcgggttcttccctcctgcgccgccatatccgcctgcgaagacatcggaataaggggaaaacgcatcatcgccatgcagggcccgttttccgaagaaatgaaccgggccatgatgcggcagctgggagtccgctatttagtgacaaaggaagcgggggcagcgggaggctttttagagaagctctccgcggcggaagcactttccgtgacagcggttgtgattggaagaccgttggaggagagagacggaattacattggacgcggcgaaaatactcctgaaagaagcgggaaccgtatccgccaaacggaagctttctctcatcgggacagggctgggaggcccgggccagatgacgcttgcggccgctgaggcgctgaaacggtgcgatgtcttatttggcgccagacgcatgacggacgcggcggagacactgggagaagcggcgtcaaaaatcctgcgggttccgatttacgggaaccgtgaaatcctggaatggcttgagagtcatccggagcataaaagagccggtgtcctgtattccggcgacacggggttttacagcggcgcgtccggtatggccgccgtgctctcggataaaccgtactgcgattcctatgaattcaccacttacccggggatttcgtccgtgtcgtacttatgtgccaaaatgggacgaagctgggagcatgtgaaactgatcagcctgcacgggcgggactgcgacgcggcccaggtgatagctcagaatccggcggtatttacgctgctgggcggggcgcacacggtaaaggaactctgtgagcagcttttaagagccgggcttaccgacgtgagaatcactgcgggggagcggctctcctatgccgatgagcggattgtgaccggaacgccggaccagcttgcaaccatggaatttacaagcctggctgtagttctgatggaacggaacgaagagagtgagggtgtcagatgagagacgaatggtttatccggggagaggtccccatgacgaagagcgaggttcgtgccgtttcggtggagaagctggagctttcgcccgattcggtcctctatgatatcggagcggggaccggttccgtgtcggtggaggccgcggcttttatgccggaaggcacagtctatgcggtcgagaagaagcgggaggccgtggagctgctggagaaaaacaggaaaaagtttcaggcggagcagattcgaatcatagaaggcgcggccccggaggctttagagggtctggaggcgcctacccatgcatttctgggaggcacctccggcagaatggcagagattctttctctgctgctggcaaagaatccagaggtccgggtggtggtgaatgcgatcacgctggaatccgtttcgaaggtgatggaatggactgccgcccgcgggatcgaggccgatatcgttctggtgtcagtttcacgggcgaaggcggcgggccgggtccacatgatgatggctcagaaccctgtttatgtgatttcctttggggggagagagacagggggcgtgaaagcggcaaagcaagcggtgacagccgaaaaggcctccagctcagaaaccgcatatccgcgtttgatgcttgccgcaccgaagagcggcagcggaaaaacgatgatgacctgcggactgctggccgcatggaaaaaacggaagatagaatgccgggcgtttaagtgcgggccggactacatcgatcccatgtttcacaaatatgtactgggaatcgacggtggaaatctggatacctttttcctgcctgaggaagaggtgcgaaatcagtttaaggacctggcagccggtgctgacctttcggtggtggaaggcgtgatggggtattacgacggtgtcggaggaaatgacacttgggccagctcctacgacacggcccgcgcccttgacgcgcccgtcgtactggttctggactgcaagggagcctcactttccctggcggcagaaataaaaggatttctggaatatagaaaagacagccgtatacgcggcgttatcctaaacaggatatctccggtgatggcggaacgtctcgtgccggagatcgaaaagctgggaatttccgtgttcggctatctgccggaatgcgacgcggcaaaagtaaccagccgtcatctcggacttgtgattccggaggagtccaaagccctgcgggagcggctggaactgctggctttggagatggagaagaccgtggatgtggaggggcttttacggctggcaggcggtgccggggaattgaaggacgacggtgaagcggcggagggcggtgcggaagccgtaatcgccattgaagcacccggaacggaacgcatccggatcggtatcgccagagacgaggctttctgtttttactatcaggaaaatataaagctttttgagagtctgggagccgagctcgtggaatttgatcctatgcgggatgagcatctgccaaaggatattgccgggctgatgctcggcggcggttacccggaactctatgccgaaagattgtcggccaacggctcccttttaagagaaataaaagaagcggcggccggcggaatgcccatactcgcggagtgcggcggtttcctctatcttcatgaggagctggagacgaaggagggggaggtctttcccatggcgggagttatcgcggggcgggcatttccaaccggaaaactgtcccgattcggatacatcgggctcgtgccctatggggacacccagcttttgaaagaaggggaagagatccgcggccatgaattccactactgggacagcacggcctgcggtaatgcgatgaaggccgtgaaaccaggcggaaagagaagctgggactgtattcatgcagatggaggtctgctggccggtttcccccatctttattatccatcgaatccgtctgccgcagagcggtggctggagctttgcaggaaaggaacttaagtcatgacagaagaattaaacatacggcggggcgtctcagaggacattcccgaactggtgcggttatacgacgagacggtcgggcatctggaaagccatgtcaactatccgggctggaaaaagggagtctatcccggaagggacgcggcggaagagggtgtggagacaggcacactctatgtggcggagactggaggccgcatcatcggttccatcatattaaatggaaagcaggaggccgcatacaacggtgtctcctggggcgtggaggcggagccggatgaggtaatggtgatccatacatttctcgttcacccggatttcaggaaatccggcgcggggaaattcctgatggagtttgcggaattgcaggccctgagggaaggaaagaagacgatccgccttgacgtatacgagaaaaatgaacctgcagtccggctctatgagcggcagggataccgttatgtggcgactgtggatctgggactgggctcctggggccttccgtggtttaaactctatgagagaacggcggaagaatgcttaaacggggtgttgtccaggatatcccctctttcggcaggtgccgcggaactggcctctctcacatggagccatgtggcgaagccgctctacagcctggggattctcgaagaggacgtgataaagatcgccggaatatcagagacccagcatgttgatatcggtaaacgggcgctgattatcatgtgcagtgataacggcattgtagaagaaggtgtaacgcagaccggacaggaagtcactgccgtggtaactgaaaatatgacggatggaaacagcagtgtctgcctcatggctgaccgggcgggagtggacgtgtttccggtggatatcggagtctccagagatctgcgttccggcgccagaaacccgctgatacgtaaaaaactggcttatggaacaaagaatttccataaagaaccggccatgtcccgggaaacagcagtatcggccattgccgcgggaattagcgtggctggggagctgaaggaaaaagggtaccgtctgatcgccaccggagagatggggatcggcaacaccacgacgagcagtgccgtggcggccatgctgctggatcgtgatccggctgaaatgacgggccgcggggcgggactgtcggatgagggcctgatgaaaaaaatatccgttatccgggaagctgtgaagcggtacggaccggaatgcagcgatgccatcgatgtgatcgcccatgtgggaggcttagatctcgccggccttaccggcgtctttttagggggcgcggtctaccgcattcccgttctgatcgacggctttatctcgggtactgcggcgcttgccgcagcaaagctggcaccggccgcccgcgattatatgctggccacccacgtttcggcggaaccggcgggccgcctgctcctggatgaactgggcttaaaaccatttgtggcggcaggaatgtgtctgggggagggaaccggcgcggttgcgtccatcccgcttctcgatatggcgctggaggtttataccaaaatgagcacatttcaggatattcagattgaggagtacaagccgctggcgcctcagactaactccggggcgcattagcagtgcatcccggcaccaccagggcgtgctggtgctcacagcgaggaggaagaggatggtaacactggtaacgggaggcagcggcagcggaaaatcggcctttgccgagcaggagattgtcagactgggaaaacggaggcggatctacattgcgaccatgaagccttgggatgaggagtgcagacgccggattgaacgtcaccgtctgatgcgggcagataagcagtttgagactgtggagtgctaccgcggtttagagcggctgaagctgcctgccgcgggaaaagacggagagctgaccggagcagcggagtatgcagttcttttggaatgcctctccaacctggtttccaatgaactgtttggaaccggggaggacgactgtccggaccgcctttccgccgaatacggttctgcggcggcggattcggtagtagacggaattctgagtctgagtaggaaagtatctgatctcgtcatcgtgaccaacgaggtgttttcggccggcgattaccgcaaacaaccggtctgcataaaatgggacgaaaacggggaaaatccggataccggagatctctgcggctgggatgaatccacggctctctatctaaaggttctgggagaaatcaactgccgtctgggaatgcttgcagaccgcgtcatcgaggtgagcgcaggaattcccgttgtaattaaataatcatgtcatacagttgtcgtgtttactgtgttacactcataaaaaagtaaggaggcagcagtatgacaccatttgattataaaaaagagtataaggcattgtatcttccgaaggagatgccatccatcgtggaggtaccttccatgcagtacgcggcggtgagaggacacggagatccgaacgagccggatggggaatacggaagggcggttgccgttctgtacgggatttcctacacgattaagatgagctataagggaagccggaaggttgacggcttcttcgagtacgtcgttccgccgctggagggcttctggtggatggaaggcggcgcgccgggcgtcgattacaggaacaagtccggatttaactggatttccataatcagagtgccggaattcgtcacagaggaggtatttgcctgggcgaaggaggaggcgcagcgaaaaaaagggatcgatacgagtcttgcggagctgattacagtttcggagggcctgtgcgtccagtgtctccatattggaagctataatgaggaaccggccaccgttgcaaagatggaccattataggatggaacagggctatgagaacgatatttctgatcgcaggcgtcaccatgagatatacttaagtgatccgaggaaggtttctccggagcgtatgaaaaccgtaatcaggcatccggtgagaccgaagattgattagagcgtatctggatatgaattttcagacatgctctgggagaggaaggaaaaaatgatagtcatgatttgtgttgacgaccataacggcatgatgttcaaccaccggcgtcagagcagagacagcgcagtgcaggagcgggtgctccggtgctcggagaacagcagactttggatgaacgagtactccagtaagctgttcccggagcctaaaccggactggctgtccgtcgatccggcatttcttgacagggcgggaagcggagagtactgctttgttgaggaccaggacattcggccatatgaagatgagcttgaatcgatcattctgtttcaatggaaccgcagttatccggcggatttccattttccggcggatatcctgtctcatggatggaccatgacggaatccgaggagtttgagggaagctcccacgaaaaaataataagagaagtgtataaaaaagatgaagagaataagtaattatattgcagttttagtcatgacggcgctgctccttgccggctgcgcccagtcaccggccccgattccggaccaggcgctggctcagacatcggctcaaatgtcagaccagacatcggctcagaccggcgaaagccaaagcactgccggtgtattggccaatgagacagagcttgtgggtagtacaggaccgaagcagttcaaagtatccgatattcccgcctattcgggagaagcgtatgccgcagtaaacgggaatgtcccctatttcgaaacgtcagatttcacgacagaatccttcgagacttacagtgatttagacagcctcggaagatgcggcacggcctatgccaatgtaggcacagaccttatgccgacagaaaaacgcgggtccataggcaaggtgaagccttccgggtggcagaccataaaatacgattttgtagacggtaagtacctctataaccggtgccacttaatcggctttcagctgacggctgagaatgccaatgaaaagaatctgatcacaggtacccggtatatgaatgtggacggcatgctgccgtttgagaacatggtggccgactacgtcaaggaaacgaaaaaccatgttctgtaccgcgttactccggttttccagggtaacaatctgatcgctgacggcgtactgatggaggcggaatccgttgaggacgagggcgacggaattttattctgtgtatttgtctataacgtgcagcccggagtcaccatagactacgctaccggcagcagtcagcgatcagagagtgcaccacaggagaccgcagcgtccgaggacggcagcacagccggaaaaaaagctgagagcagcgcagaaagtaaaaacgaaagtaaatccagtaccgagaccacttatattttcaataccaatactcacaaatttcactatccttcctgttccagtgtttcacagatgaatgaatcaaacaagcagagcttcaccggcagccgggatgaagcgatcgcgcagggctatgagccgtgcgggagatgtaagccttaattcctttttctgacggctggtatctttagctataaaatttacagttgtagtgggggagaggctctgtgcccctcctctttcccgtcttaactccaggtctctcccaggcgtatctttcaacctccaaatccaattttgcgccggtaaatacgaattgaaaccgtgatattttttaaaatattatagactttatacgcctgtatatggtattatatacataagaaacacgtcactaaaagttaataattggattgtaaaaagtatggttcaatttacttgtatggaggtatatatgacagatacagaaaaaattgatcagatcctattaaaaatggaaagttttgcgacaaaagacgatttgaaggtctttgcgacaaaagacgatttgaaagactttgcaacaaaagacgatttgaaagcctttgcgacaaaagcagacttaaggcatgaaaccaatttggtgttggaagagttggattcaacggagcagagactcaaccgaaggattgattcaaccaacaaagacctgcaagagttacgtcaatatgtcacagctgtgcgatataacaatgagattgtcgaaattctgatgaaacgacaggacaatgtagaacaaagattgcaaaaagtggaaagaaaggtgttgtgttcataagttgtaacagttcagacggcaggataattggcgcataagttgtttggatctgtctgtaaaaggcagaaaacaattgaaaatatttacagctcgtgatatgctattactgtatcctgacgccaaaaacatgttttgaggcgaaaggttcggctcgagataggaaatataacatggaatgcagatcgcattcttttcttgccgtaccttttggggtgcggcatttttgctttaacaaaatcaacgagaattctcccagcctctacaggtgggagatgaatcgcaaaaacaaacttagcgtcagtggcgggcagatatcccccactgacatgaggtcaaaacaatccgggcaaccggataaaatggcagcatagctactatgtcattctgagttttgtattctgaactcagaatgtggattgaaataatatttgaaatattttaagattccggaggtgtaacgatggaaacaaggatcgcggtggtgggaatcgttgtggaagcagaggaatccgtagaggaactcaacgaaattcttcatgaataccgccagtacatcattggccgtatggggattccctatcatgagaagaagatcagcattatcagtattgcggtggacgctccccagagtattatatcggctctttccggcaaggtgggaaaattgaagggagtcagctcgaagaccgcctactcgggagtgaaatcatgagcgacgctgcaaagaaggtcatggacttagccgtgcggctggcggagaatcacgatctgccggatgacgcgctgtatacgctgattacggaacggaatgaagagacagccctgtttttgagaaacgaggccagagcactgtgcgaacggatctacggacgcttcgtctatatccgaggactgattgaatttacgaattactgtaaaaatgactgttactactgtggaatcaggagaagcaaccgggaggcagagcggtaccggctgacagaggaggagattctgtcgtgctgtgaggccggttacggcctgggattccgcacttttgtgcttcagggcggagaagatccctattttacggatgaacggcttggctccattgtggcgtcaatccgagggttgtgtccggactgtgccatcaccctgtcggcaggggagcgaagccatgacagttatagacgtctccatgatgcgggggcagaccgttacttactccgccatgagacggccgatccgtgccattacggtaggcttcatccggagtcgatgagcttcgataagcggatggcggcgctgaaggatttgaaggaaatcggttatcagactggctgcggctttatggttgggtcaccataccagaccgcgtccatgatcgtaaaggatctgcgcttcatgaaggaattcggtcctcatatgattgggatcggaccgtttctctctcataaggacacgaccttttgtgatatggaaaatgggacagccgaattgacactgtatctgctgtcggttatccgtctgatgatgccgaaggtgctgcttcctgctaccacggcactcggaactgtgacggaaggcggcagagaggcgggaatcttaagcggcgccaatgtggtcatgccgaatctgtccccggcaggtgtccgaaagaagtatatgctgtatgacaacaagctgtcctccggctccgaggccgcggagagcctggaactcttaagggaatccttaagtaaaatcggttatgggattgccgtctcgcggggcgacagtcttgtaatataaaaatgaatgactgacggagaagcatttgctgacccggaagaaaggaaggaatcatgtataatccagaatcgttaaaagcagaggaatttatttcacacgaggagatccaggagacactcgactatgcggaaaaaaacaaagaaaacgtggagctgattgactcgatcatcgagaaggcaaggcagctgaagggactcagccacagggaggcgtccgtgcttctggcctgcgagatgccggacaagattttagagatgtataacctggcggaagagattaagaagaaattctatggaaaccgtatcgtcatgttcgcacctctctacttatccaactactgtatcaacggctgtacgtactgtccgtaccacggcaagaacaagcacatcgcccgcaagaagctgacgcaggaggaagtggcaaaggaagtaatcgcccttcaggatatgggccataagcgtctggctatcgaggcgggagaggacccggtgaggaatcccatcgaatacatattggaatgtatcgatacgatctattccattaagcataagaacggagctatccgccgtgtgaatgtgaatattgctgctaccacagtcgataactacaggaagttaaaggacgcgggaatcggaacctacattctgtttcaggagacgtatcacaaggagagctatgagaagcttcatccgacgggaccgaagcacgattacgcctaccataccgaggctatggaccgggccatggacggcggaatcgatgatgtgggacttggcgtactcttcggactggagctctacaaatatgagtttgcaggccttttaatgcatgccgagcatttagaggcggttcacggtgtgggccctcacaccatcagcgttccgcgtatcaagcatgccgacgatatcgatccaagcgcatttgacaacagcatcagcgacgacatctttgcaaagctctgcgcattgatccgtcttgctgtgccatatacgggaatgatcatatccacaagggagagccagcaggtgagggaaaaggtgatccgcctcggtgtgtcccagattagcggcgcttccagaacgagcgtaggcggttatcaggaggagatccggccgaccgatacggagcagtttgacgtttccgaccagagaagcctcgacgaggtggtgcgctggctgatggagatggggtatattccgtccttctgtaccgcgtgctatcgggaaggcaggaccggcgaccgtttcatgagcctctgtaagagcggccagattcagaactgctgccatcccaacgcgcttatgacgttaaaggaatttttgatggattatgcctccgaggacacgaaagccatcggagagaagttaatcgaggcagagctcgccaatattccaaaagacaaggtgcgggatatctgtaaggatcatttggaaaagatcgaacagggaatccgggatttccggttctgagatagcatgcaggaatgaattttcaaacatgctccaggtctctgtcagcgatggcggagtggacagaaataaataaaagacaactcagaggactgtggggtgaagaaatatgggactaagtgatacgccgggcggcgagcgcatacacatcggcttcttcggccgccgcaatgcgggaaaatccagcatagtaaacgcggtcacgggccaggaactgtccgtggtatctgatatcaagggaacgacgacggacccggtctataaatccatggagctgcttcccatgggccctgtggtgatcatcgataccccgggttttgacgatgaaggcgctctcggagagctgcgcgtgaaaaagacccgggagattttaaacagggcggactgtgccgtgctggtggtcgattcggttttgggaaagacgaaggccgatgaggagatgctttcactatttaaagagaaacagcttccatatctgatcgcttataataaatgggagctgctggacgaaaaagagcataaagcaaaagagcagacagcggacgaaaaatctgtttttgtcagtgccgagacgaattaccatatccaggagctaaaggagaggatcgccggcctcgtaaaagagaaggaaaatggctgccgtctggtgggagatttcttaaaacctctcgatcttgtggtccttgtggtccccattgataaggccgcgccgaagggacggctgatcctgccgcagcagcaggccatccgggatattctggaggcaggggccatgtccgtggtggtgcgcgacacggagcttttagcagcgcttaagaagctgggccgcgatccggatctggtgatcacggacagccaggcattttccgaggtggccgaggtggtaccggaccatgtactgctcacctccttttccgttctgatggcaagatataaaggattcctggatgcggcggcaagtggagtgaaagccgtgaaccagctgcaggacggggaccggattctcatatctgagggatgtacccatcaccggcagtgcaatgatatcggcacggtgaagattccggcctggattaagaaatacacggggaagaatgtcatcatcgaaacgtcctcggggcgaagctttccggaagacttatccggttaccgcctggtgatccactgcggcggctgtatgctcaatgagagggaagtcagataccgcatgcagtgcacgggggacgcgggcgttccctttacgaattacggtatggtcattgcgcagatgaaggggattctggagcgaagcatggaaatcttccggaaggttcagtgattagtccgggaaaaatatttccggcttgcgggaataacagcagagcaggaaggataacggaatccgcgttatctttcctgctttttgtatcataaaaaaaggactcttagtacaggaatgatttacagagaaggaaccggcagtgcagaccgggcgctgaggcggttcgtcgtctgtgaacacggcgggaaatggaaaaaaataccatatatggagtttaaggactactcagcgtgcgttccaaatactgattatttcatgtaaaataataaaagaagtattttacatcaggaaggatttattttacatgaatgataacagaagtaaaaatcagccgcgagtacggaaatttccatcagagccgaccggggagaagggcccgggacgtgcatcaaagggcggacgaaacaaagaggaactgctgcgtgaaatggggaaccgcctgaggcagatcaggctggaaaagaactggactcaggataagatggcggaatgtctcggtattacgaaagcattctatggaaaaatcgagaggggagagagcagtattgccctggaaaaactggccctgttgaatgaaaccatggacattgacttaaactatctgataaccggggagacaattccggtacttccgatcaattttcaggatgttccccgcgagaaacgatacagcatggaacagcttatcaagtatgccgtcagtctggcatcatcaaaagaggagtgacagagaaatgagaattttatcgttgacaatcagacttcacgccccgtgggtccattctttaaaggagaagcggatggtggtgaagagtctgactgcaaagcttcgcaataaatataacgtatccgcagcagagaccgatgaacaggatattcaccagattatcgtcatcggagtggcctcgattgccgcaaaccacgcccaggccgacagcatggaggaggagattctgcattttgtggagtcgaatacggaggcagagctggtggaacacgtgaaagaagtattttaaaggcagagataaaaaagcagcattgtaaaaaacgggcttgacagaagcggaaaaaaggaatatagttactatactgtaaagctacttaacaagatcggaggcagctacatgaacgattattcgcagatgacggtacttatggagcggatcattcataaatacaatcagtgggagaacagaaaacgcacgtatggcacaaagatgctgctgacccgatcagagattcacacgatcgcggccgtaggagacaatccgggaatcaatatcacggctctggcctctgcgctgggagttacgaaagccgccgcctcgcagatgatctataaactggtggataaaggcgtcgtggagaaggcggtatccccctattcggacacggaggtggtcttaaacctgacggaggaaggccagaagaattatatcgcccacagggagatccacacccgctcggatgaagaatctctccggctgattcaggagatgccggagccgttctgcggagagatgattcagttcctgaccgcgtttgaagaaattatggataagagattaaaagaagaataggctgtcactgacagcatttcttttttttactatgttaagtatatttacagtaaaccatattaacatagcgttacattgacagcgcgccacactaacatgggaagcacattaacatgggaagcacaataacgagcaccacactgagaggaaagcataaggaggaaatcatgatgcaggaatatcgcacaaaggaactttacggagatttttatgagaatgaaggaaaaccgctggtggtaatcataggcggcagcaggccgggacttccggcgcctttgaacaaagattttttagaacgattaaagaaagattttcaggttctgctgctggcgtacttcggcgccggtgatcttccggagagtcttgagtgcctgccgatggaatactttgtaaatgcggtatccgccgtaaaacaggagtacggcatcggcgacagggaggtgatcgtaatcggccagtcgaagggaggggaagcagcgctgctgctgacaaactatatgagatcggctgtgacaatcgcgctggttccttcctgctatgcgttccagggactgcccgcggaattcaccctggagagctttacaaacaggaagtcctcctggtcctttcagggaaaagaactgccctatatcaaattctattttgaccgggagattgtaaaggagattatggctggaaattactgtacgtgttatgaagcgtcgatagagaaaaacgggaatgaagacgcgctcatccgcgttgacggatacaccgggaaaatacttctgatttctgaggaaaacgacaggtactggccgagccgggcgatgagtgagcagctggttaagagaagcggaaacagagaaaatatgagacatatttccatgaagctggacggccattatctcatgaattatgaggagtctgccggggaaatcgtgaagtacctggaagagtatctggccggtaaaaggtgatgctcccttaaattttgaaagagagaggctaaaaaaattccagataatttactaaaaaagtttatttactaaaaaatttgaatacttaaaattaatggattgacaagaaacgacattattgttatactaatcccaacaaatgcaaagaggcagaaaatggagttcattttctgcattttttgtaaatatttgctttagcgaactaaagcgaaaggtataggaggactcgttatgagaaaacgtagaagtgtacttgcagcaatattactgtccgcgatggctcttacaaccgcatgtggtgggagcggcggcacgacagaaacgagcggcggcgggaacgttcaggctgaagcaggatcggaagcgggaaatacgggggaggaaaccgtagtacagattggccagacctcagaggtagccaacttaaacccgacgattcagccgagaacaccagacagcaacgtgcagtgtatgatctttaactatctggttattccggacgaagaactgaactacgtgggggatttggcagaaggatgggatgtatcggacgacggcaggacgtataccttccatttaagagacggcgtaaagtggcatgacggagaaccgtttacctccgccgacgtcgcatttacattaacctctctggcggcaccgacctacaagggcggcgcggacagccgtatcgtctccatcgtcggagccaaagcgtaccaggaaggcagcgcagacagcgtatccggcattaccacaccggatgacaagacggttgttgtggaactggaagaggcgaatgccgcgtttatcggcaacatgtatacctgtattctgccgaagcacattctggagaatgtggatccaggcacatgggataccgacgattttaaccgtcatcccatcggaaccggcaagtacaaattcgttgagtggaagtcgggccagtacatcgaactggagaagaacgaagattacttcggcacaaagccaagcattgaccgcgtctatgtgaagttcggcgacgagacaacactgaccgcttccttaatcaatggcgagctggacgttctgtatggcttaagtgcgtccgagattgagactgttgaggccatgggcggcgtcagagtggaagcgtacgatatgttaagcgtatactatatcggcttaaaccagttaaatgaagacttaagtgatttaaaggtacgccaggcactggcttacgggattgacaaagataagatcgtagcgacgatttatggagagaccggttacgtgcaggacagcattttcccgagcaaccactggacctacagcgacgatgtaacgaagtatccgtacgatccggcgaagtcgaaatctcttctggaagaggctggatatactatgaatgcatcgaccggattctacgagaagaacggcaagacgcttcatcttacctatgacctcgtaacaagcacagacggcaattccgtagctcagctgatccagcagcagtggaaggagatcggcgtggagatggagatcatcgagcaggatttctccacactggcttacacgaagctgttcccatccgatgacaacggcagcccacgccgtgtaacggcggacgatttcgcctgctacaccttaggcttcggcatggaggccgatccggacgagtacagaatgtacttaaccacagcagatgcaccgggtacctggaatttcgttacatacagcaactccaaggtggatgaattatttgagaagcagctctactccacaaaaccggaggagagagcggcctgctaccatgagatcggcaagctgatctccgaagatgttccgtggattccgttatacggtaaaaagagccttgcaggagtcagcgagaaggtgcagaacttcgcagcagacttccgcggaattacattccagattgaaaaatggaacattgctcagtaaatcaaacaccccgccgcaagctgcggggtgtttgcccccgcgggcagtcgtcaaatggacatgccagcatgcccacctggctcgttgccttcgcgagaataaatgaatgaggtaaatggcccaaagcatattgttttgggccatttcaccaatggagacccaaatgaaatacgattatacagaagttttaaaggacctggtcaggattgataccaccaatccaccgggaaatgaaaaaagggcgcttgattatattcaaaagattcttgaacaggaagggatcgattcgacgatttacgagagcgctcccggcaggggcaatctcctggcctgccttccggctgacaaagatgtgtctgatgaaggtggggcagactgcgcggcggccgaacggccgctgattctcctgagccatattgacgtggtcctggcaaaggaatcccagtggaagcatcctccctttgctgcggtggaggaggacggcttcatctatgggcgcggcaccgtggacacgaagcagctgacagtcatggaactggctgcccttctggcgctggcggaaaatggagagcaaaggaaacgggatgtctttcttcttgtgacctgtgacgaggagagcggcagcgcactcggactatccgcatttctcgaggaaacagtctccgcaggcggccgtaccatcacgggaaaggaactcttcgaaaacagtgaggtaatcagtgaaggcggaggcttcccgatcctggtgggagatacggctttttacttatgtgagtcgggccagaagggatgcggcaccgtggaatttaccgtggaggccagaaatgccaaaggcccattcttcggaagcggagacgggatggtaagagccatgaagctggtggccgatatcggggccctggagctggagcagaggaagctgcctacagtagcgcgcttcgaaaaacggctttccgaatgtgcggacggcaattgccacggtgactcgggcgcagagcgtgcgagtgatcatttcagagaggcgctgtccccggtcatgaacaatattctgacggccatgaaccggaataccatgaccgtgaccatgattcagggaaaaagcgtcaatcaggtaaaggtgatctgcgacgtgcgccttctgcctggttacggaaccgcatatctgaaagaaattacggaccgcctggcggaaaaatgggatgccgaatgccggattctatccttcagcgagggctatgagagtcagccggagggcggactgatcggatgcctggaggaagcgacaaagatggagctgggagaagatgggaaacgggcggaagtgcttccgttcatttccatgggatccagcgacggacgttttctggttcccatgaaggcgaaggtatacggctacagtccggtcctttcctgggacatgacctttgatcaggccgtttccatggttcacggcgtcgatgaaaagattcaccgggaatcggtgctgttcggatgccgggtacttgaaaatgcggtctgcagggcggtctgcggccggattcaccaatgaaaatgaaatcgaaaagaaagaaggggaacattatggtagacagaaaaaatgtagcggttgaaaagatggaccgcgcagtccagatgttaaaagaaaatcagatcgatatgtggatgttttattccagactgaatcaggatccgtcactggaactgatgttcaataccgatacgaagaacgaggtcctgttcgtgctgacggcagaaggggataagatggcgtttgcggaagcgtcagacgcggcggtatatgaagcggccgggatctttaccagtgtgaggaccgtgacaccggatacggtaatgaaggaatttgcagcagtgtgtgacgaaaagaagcccaatcggatcgcggtcaacgattccaccgaggattcccgctgcgacggccttggactgggactctataaaaaagtatgcggggctctgggggaggaacgcatgaaagcgttaaagaccggaagctaccggatgctggaagaactccgtgcggtaaagacccccagcgagattgccatcatggaagagtgcagccgcttaacgaccgatatttacgatgcactttttgcgcgcctccatgttggactcagtgaaatcgatgtgggagatattatgatggaagagtgtgcgaagcgtaacgtcatcaccgcctttggaaatccgccggaatatccgctggttcttctcgtcaagggaggcatgtcccacaggaagccgaacgcgaagaatatctgccttccgggtgatatgctggtcatcgatttcagcatccgctttaacggctatacctccgacatcgcgcgtaccatgtatttcttaaagccaggcgaggagcatgcgccgaaagaggttactgactgtgcaaacggggcaatccgtgccgtcggtgaggtcatgaaggtgatcaaaccgggcatgaagggctacgaagtggacgcggtcggaagacagtccattctggacagcggttatcccaatatccctcactccgtaggccatcaggtaggtctggaagtgcacgacggcggaacgaccctcgggccaaataaagccaggctaagctgccagggcgtcttgagaaagaatgagatctacgcgctggaaccgaccgtacttcagccggatggacttccctgtgcgatcatcgaggacgacgtaatcctgaccgatgatggatgcagactgatcagcaaacgccagacagcgttgatcgagatcccatacagagaggcttaattcatggaaaatgtgaaagagacactgatgcatctcatttcaattccctcggtaaccgcatctccctccgagaaggaggccgttatcttcctcgaacggattttgaaggaggaggggatcgagactgagcggatctttaaagatccggaacggttaaacctcctcgcccatttaccggccgaacagccggaggaagggcccctcgtgctaatttcccatgtggatgtggtggacggcgattctgacaaatggaactggccggtcttcggcggagtggaagaggggggcagaatctacgggaggggaactctggatacgaagcatttaaccgtcatggagctgaatgcatttctgaacctgaagcggtcgggaaggaagctgagacgcgacgtctggttcctggctaccatcgatgaggaagcgggaagtaaattcggtatggagtacgtgaaagaggccaggccggagctgtttcagaatgccatggtaatcaatgaaggcggcggatttcccctccggattaacggaaatgactacctgatgctgactgtgggagaaaaggctgtgtgccgggtaaagcttacggcctcgggccgcggcggccatgccagtgcgcccggtgacgatcaggccatcttaaagctggcagccgtgctggaagagatctttggagcggaggatgagctgtgtttcggaagccacgcgacacaggaaaccatggcccggattctgggcggccgcacctgtgacaatccggtggcggccgatatcttcggatacgcgggacagaataccatcggtctccgggattaccagatcggagaccggagcaatgtgattccggccgcggcggaagtggttctggaatttaaagtgcttccgggcacgagggaagaggagatcgaggcgtttgtaaaacgccatgtgaaggccggtgtacagtatgagatcctgagctttgagaggggatttgaaagcaatttcgacaattccgccttgaaaagcctgatcggggatttgaggacgatcagcagggaggagggcttctcctgcgaggtacttcccatgcttgcgctgggacgcacggatggccgcttcttcggttcggaaggcagcatggtttacggatgctcccccctgttaatggacgattccttcgacgcagtgcttccgaaggttcacggaaatgacgagagcatatccacggaatcctatctcttcggatgcagggtgttggaccgcttaattgagaaaaactgtttgtgagccgcaaaagagcggcctgctattacatagtatggaggaaaatatgaagaactttgaatttcataatcgtgtgatccacgacgtgactgagaaactgaaagaactggacatagacttatttttaatcattaccagcgagggaagcgataagatgacccggttcatccccggagtcgataccgtgggttccggagcgttcttctttacaaaggaaggaaaacgctacggagtggcgtctgccatagacgctcaggacgtagaggaatccggcctgttcgacgaggtgatccgctatcaggactacgacagcacggttgccgggctgctgaaaaagctgaatccgaagcgggtagcccttgatttttccgagacggatgcggaatgcgatgggctgacactggggcggtatgagtattataaggctcatatcaagggacagctggagtttttggaggtcagctctgatttgtttattccacaggtgaaggctgtaaatcaccaataagatcaggaggttatcgatgggaaaatacataagaaaacggttaatacagtcaattcccgtggtgttcggcattacgatactgacctatttcatcatgaaactggcgccgggcggccccctggccaatatgatcaatccgcgtacttctgcggagtctatcttaagggccaaggaagcgatgggcttaaataagccgattatcattcagtacgtcaactggctgagggagctgctgcagggcaatttcggctacagcaccaactcaggacagcaggttctggccatgattttagagcgccttcccgctacgctgctgcttacggtaacggcgtttgtcatcagctttgtggtgggaattccgctgggcgtatactctgcaacccacaaatactcggcaggagattacggccttaccatcttctcctttatcggtatttcgattcccagcttcttcttcggcatgggcctgatctacatcttcgccataaagctgaaatggtttccgacgtcgggctttggcgataccacctttaaggggaccgggatggctctgttcctgaataagatgaagtaccttgtcatgcctgcccttgtgatgtccctggccaatctggccacggtcatgcgctttacccggtcgagcatggtggaaacgctgaaccaggattatatccgcacggccagggccaaagggctctcggagaaggtggtcatctaccgccacgcgctgaagaattccctgattcccgttatcaccatcttcggtttatccatcccgaatttattcggcggcgcctatatcacggaaaaagtgttcagctggccgggtatggggcttctgggcgttgacgccatcgcaaacagagactacgcagtgcttatgggtctgactctgtttacggcgattctggttctcgtgggcaatctcgttgcggatattctctattccttcgtagacccgagaatacgatactaaggaggcttccatggagaaaaaaattacatataaaaaacggactaatctctttaagacggatgcgtggaagcggttcagcaaaaataaactggctctgatcggaagcgtcatcattcttctgatgattgccgcggccatactggcacccctcatcgtacagaatgatccgtatgtgtctttaaccgatgcaaacggcctcattttaaagaacagctctcctgcgaagagcggcacgattctggggacggacagcctgggacgcgatacgttcagccgggtgatctacgcggccagagtgtccatgagcgttggcgtggtggcagtcggcatttccaccggtatcggtattttattaggcgcgctggccggttatttcggcgggtgggtggatacctttatcatgcgtgtggtcgatgtggtctactgctttccggtgcttttcctggtcatcattatcgcaaccatcttaaagcccagcatctataatattatgattatcatcggcctctgtaactggaccggaacggcgaggttcgtcagaggcgagattttaagggtccgggagctggagtatgtgcaggcctccatctcactgggggcgacggatggacgcactattttccatcatattattccgaatatcatggctccgattatcgtggaagccacccttcagatggcgagggcgatcctgacagaagcttccttgagctatctgggtgtcggtgttcagatgccgacggccagctgggggaacatgctgatgagcgccaacaacttatccacgctgacgctgcgcccgtggcagtgggtgccgccgggagtctgtattttcctggcagtgctgagcatcaactttatcggtgacggcttaagagacgcgtttgacgcaagacagaagaagtaaccgcgggacaggagtttaaatgaagaagatacaatatgaaaagaggctgtcgggcctcagagcttacatcgaggatcacggccttacgggagctctgatcacttcgtatgaaaatcgcagatatttctgcggatttacagggagcagcggttaccttctcgtcacgcgtgaccacaccgttctcataacggacaaacggtatacgacccaggcgaaggagcagactgtggactgcgagatcgtggagcacagccaggaccggctgggactggtggcggacaccatgaagcatcttggaatcacttcttccgtcatggaaagcggcatgaccgccggagagtatttttccttaaaggagcacttgggagaccacaggaccgtgctggaggatgagtacttcctggagctgcgcatggtgaaggacgaatgggaaatagaagccaccagggaggccatccggcgcgccgaggcaggctttgaccggctgattccgagacttaaaatcggtatgacggaaaaggatttagcggacgaacttcattacctggtaaatagagagggcgccgaggccatgagctttggaaccattgtcgcctcgggggcgcgaggagccatggctcacggatttccgacgaacaaggtcatcgaaaacggtgatatggtggtggttgacttcggcgtcatgtacgacggttactgctccgatatgacgaggacgctgcttttcggagatatttcccaggaaaacaggaggatttttaatctggtcctggaatccggaaaacgggccgtggaagcggtgcggccgggtgtgcactccagcgaggtggaggcggctcacagggatgtatttatcagagaggggctggacgattacgcgcttcgcggattggggcatggaatcggccttcagatccacgaatgtccgagagtccagattggaaaggacacggtattgaggccgaatatgatatttaccatagagccgggcctctatttcccgggagtctgcggcgtccgcacggaggatgacgtactggtgacggaaagcggagtggaaaacctttcccatacgccgcatgagattcatattgactaggacatgacagaatgcaatttttcgatcatgctcaaggagaggagaccgttaatgagcttattggaagtaaaagacttaaaaacatatttttatacggatgcgggctgcgcaaaggcggtggacggtgtatccttttccctggacaaggggaaggtgctgggcatcgtgggcgagtccggatgcggcaagagcgtgaccagcttatcgatcatggggctggtggacccggtgacgggaaggcatgaaggcggggaaatcctgtttcacggggaggacttaagcaagctttcggaaaaggagaagaggaagatccgcggtaataaaatctccatgatcttccaggaacccatgacctctttaaatcccgtgtttaccgtcggctaccagatcgaggaggcgctgatgctgcatctcggtatggataagaatgcggcccgccagagggcagttgagctgctgaagctggtggagatcccggaggcggaaaagcgggtggatgagtatccccaccagctgtcgggcggaatgagacagagggtgatgattgccatggcgctgtcctgtaaccccgagctgctgatcgccgatgaaccgaccacggctctcgatgtgaccatacaggcgcagattctggagctgttaaatgaactgaaggacaagctgggcatggccatcatctttattacccatgacctgggcgtgatctcggagatggccgacgaggtggtcgtcatgtatgcgggggagattgtggaaaaggcggagacacgccagctttttgacaaccccatgcatccttatacggaggggctcatggcctccatccccgacatcgatcaggaggtggacaggctccagactctggagggactggttcccagcctctatgatatgccgtcaggctgccggtttggcccgcgctgcaagtattatacggaagagtgcggaaagaaccacagccagttgacccggctggaaggccaacgagaagtcagatgcaggaggtatcaacatgagtgaaatcctgattcaggcaaaaaatataaaaaaatacttccctaccagtgacagaggcaaggtcgtgaaggccgtggatgatatcagctttgatatttacaagggcgagaccctgggcgtggtaggggaatccggctgcggaaaatccaccacgggccgcatggtcttaaagctcctcgactgtacggaaggaactgttctgtacaaggggaaagacatcggaaagatgaagggaaaagagatgcgctctttaagaaaggagatgcagatcattttccaggatccttatgcgtcgctggatccgagaaaaacggtatttcagatcctggcggagccgttctggattcaccacccggagatgagtaaggaagagatctaccgggaagtggaaaagctgatcgagtgcgtggggctgcgtcccgagcatatccttcggtatccccacgaattttccggcggccagcgacagcgtgtgggcattgcgagagcgatcgcccttcatccggagttcgtggtctgtgatgagccggtcagtgccctggatgtatcgatccaggcccaggtaatcaatctgatgcaggacatcaaaaaagagtaccagctgacctacctctttatctcccatgatctgcggatcatcaagcatttctgcgaccgtgtcatggtcatgtatctgggtaatatcgtagagcttggaaccaaagaggcgatctatgggaaccagaggcatccctatacaaaggcgcttttatcggcagtatccaacgtaaaggggcacggcagcaagaaccggattatcttacagggcgatattcccagtccggtgaatccgcccagcggctgcccgttccatacgaggtgcagctactgcatggatatctgcagggaaaagaaaccggaattaaagaagatggccgatggcacgctggtagcctgtcatctggatatggaataaaactacaactatttggaggatggaacaatgaacaagatcgtaacagaaaacgcaccgaaggcgataggaccgtattcacagggaatggtatttgaaaatctggtattttccagcggacagataccagtcaatccggcgaccggcgaaacagaaggaaccaccatcgagacacaggcggcccagtcctgcaagaatgtggcggcggtgctggaagcggccggaagcagcatggagcgcgtgatcaaaaccacctgctacctcgcggacatggcggatttccctgtgtttaaccagatttacgagacgtattttgtcagcagcccggcgcgttcctgtgtcgcggtgaagacgctgccgaagaacgtgctgtgcgaaattgaagcgatcgcttataaggaatagaagaggagaggaccatggctttattcgatggaaataatataaaactggatgtgctgaaaaaatgggcttacaattaccgctgggcggaggtgccggagggaaccattcccttgacggccgccgatcctgactatccggtggcgccggagattcggaaggcgcttcgcgattacgtcgacaacggctacttttcctacacgccgaagatgggctatccggagtttatggaggcggcctccaaagcgctgtgggagcggaaacacgagaaaatcagtgaggattgtatccttccgattgacagtgcggccagagggatgtatattatcgctgagacgtttttaaaaccaggcgatgagatgatcgtgtttgacccggtggattacttatttaaagagtcctgcctcgctgccggcggcgtgccggttctgttcccggcgaagctgaaaaacggttatattgacttgagcgagctggaaaactatataacgccaaagacgaagatgatcgggctgtgcaatcctcacaatccatacggtgttctgtaccgtcaggaggatttggaacacatcatgagcctctgcgagaaatacggtctgtatatcatgaacgatgagatctggtccgatatcgtgtatccggagaatcagtttttaagcattctctctctcggagaggaacggacgggacgtgtcatgagcgtcttcggcttctccaagagctttggtatcgcgggacttcgggcgggaatgatctactgtacggacaaagcggtgtttgaccgccttgtggataagtccgcggtgatgactacggcgggcggtatcgcttctgtctcccagattgcgggaattgcgtgcttaaaggagtgttactactgggtagatgaatttatcggccatctggtacagaaccgggattacgcggtggagagaatcaaccgcatgccggtgatccgctgccataagccgcaggccacgtatcttctgtatgtggatatcagcggtctgggtgtgccttcctctcagtttaccgattacctgatcgaacacgccggccttgcactggttccgggaggggacgcgttctttggcccgggatcagagggctgcatgagaatctgttttgccaccagccatgaaattctggaagaaggcttaaaccggctggaaaagggattaaagatgtttctggaagaaaaaaaataaggaaaaggtcgagttaatgatgcatgaaaatcttcaggtaattcaaaaaatgttaaggagcatccatcagatgctcggcgacaggtatgaggtcattctgcacgacttaagccatgtggaaagctcaatcgtgggaatagaaggaagcatcacccacagaaagattgggggaccggcgacgaattacctgattcaattgctgagagagtacggggatgaggcaaaagacagcatcaattataaaaacgttatgcctgacgggcgtgtactgcgttcctccaccatttttatcagagacaacgatgggaaaatcatcggttcgctctgcatcaaccaggatctgacggattttatggttgccaaccggctgctggagcggctggtggaatttaagaatgaggagcacgaagtgccgaaggagatgtttgcccaggatatttctgaggtcatggaatccatggtcggcagcgagctggccctggtgaataagccggtggcctacatgcagaaagaggacaaactggccctggtggacgatttggagcacaagggaatctttgatgtcaagggctctgtggaatacgtagcggagtgcctgggcgtgacaaactttactgtttataattatttaaaagaaatcagaacgaagcataagtaaccgcgtcaagcggagtgggagtccctgcagggtaaatggctgcaggggctccttctttattctgttactgttgacggcccgctgaaattctccgccaggcatcgcggtacgtgggcggaacaggagaacgaaccgtttcttgtttcctcagtggcaggaactaaagcagaaaagcaggaaaaagaggcggatcgcgcaaactacggcgaactcctgaaggacttcacctccgtgtccgcttgaaatctggcttggaggccagatttcaccacccctttttcctgcttttctgcttaagttcctgcgaacctcggaaaaggaaacggttccttctcctgttccgcccacgtaccgcgatgcctggcggaggatttcagcgggctgtcaatagcagctttattctatactgcccgatataaaatgtatctgctctctgtacgaaatccctgttttgttgtatgataatagagataatttttataatgggaggaattgaacgatgaacttactgggcagcctcgcaatcgcgttttccatgtactccagaatccccatgccccaggtatcctggacgaaggagcggatgaaatacgccatgtgcttcttcccgttaatcggtgtggtgatcggagccttgacgtacggttccgtgctggtgcttacggcgcttaagctggactggatggctaaaatattaccggtcctggtacctctgatcgttacggggggaatccatatggatgggtttctcgacgtgacggatgccagagcctcgcacgcgccggtggaaaagaaactggagattttaaaggacccacatacgggggctttcgccataatcggctgctgcgtgtatctgctgctctacgtagcggttttcggagagatgaaaccggtgcttctgggagcctacggagggatttttgtgatatcgagggcgctttccggacttgccgtggtgacctttccgatggcgaagaacagcggactcgccgcgtcattttccggacaggcacagaagaagacagtcgccgtgaccatgtggtgctgtctggttctggcagaaggctggattctgtatgcgggaggggccgcggccgcatcgatgacagcggttggcgctgctctgacatttttgtactattactgtatggcgaaaaaagaattcggcggaattacgggagacctggccgggtatttccttcaggtgtgtgagctggtactgacggcggtgctggcggctgtggcccggtttaccatataaagaaccggacaataacatgaaacgaaaatgatgacaggagaatgtttatgatatttattacaggcggtgcgtggcagggaaagacggcatttgcggaaacacttgcagcaggccgggccacgccgggaataggagaacacgtactgtacgccggtcccaaaacggaagagagaacgcttccggtggccagcggacggagggatccgttcgaaacggcccttgagcggccggttatcagcggatttcattactttgtgaggagactgctctgggaagagcgggatgtcaatgaatttatagccgcgattgaggcgaagaatccggatgtcgtgattaccgcggacgagatgggatgcggtatcgttccggtggacccggaggagcgggcatggcgggaggcagccgggagggcggccgaaaagctggcggcagattccgaagcggtataccgcatggtctgcggcatcgccaccaggctgaaatgagggagaacagatgatacgttaccatatactggctgcatttgcgggctgtgccctcgatgcgctgtttggagatccacggaatataccccatccggtctgcggcatcggtaatctgatcgcatggatggaggcacggctccgcaaatggtttccggcaaacgaaaagtcggagagaagggcgggaaccgtgctggtcgtcgctgttcttctgatcacaggacttgcctcggtgctcgttctggctgccgcgtacacggttcatccattggcgggagtggcggtggaaagcgtgatgtgcgggcagatgatggcgtggcgttctttgaaaaaggagagcatgaaggtgtatgacgcgctggccgccggagatacagagggcgcaagaaccgcagtctccatgatcgtagggcgggataccaaagatctcacagacctgggaattacgaaggctgcggtggagactgtggcggaaaatacctcggatggaattattgccccgctcttttacatggtgctgggaggcggaaccgggatatttctctataaggcggttaataccatggattccatggttggctataaaaatgacaaatacataaacttcggaagaacagcagccagactggacgatgtgtgcaactacattccggccaggctttcggcctgtttcatgatcgcggcgggttatgtcctggaggcggcagaaggagccggaatgcggctgagaaagagggctgagtccgaaaaacatcattacagcggaagaggcggaatccggatcttcagacgtgaccgttataaccataagagtcccaactccgcccagacggaatcggtctgtgccggcgtactggggattcagctggcgggaaacgcgttctacttcggaaagctgtacgagaaaccgactatcggcgatgcagaccggtccgtggaatatgaggatatccggcgggcaaatacgctgatgacgggaacgtatgcggcggcgctgtttgcagcggcggttcttgggcttctggttacaataccatttattagataatccggcactgtacaacagactgtaaaatgacagaatggagatatacatcatggaataccagcatggaggagacatatatacgaatcaggtggagctggattactccgccaacctaaacccgctcgggcttcccgagggtgtgaaaaatgcttacataggggcggcagactgctgcagcgtgtatccggacagccggtgccaggcccttcgaacgaagctggcggattaccaccggatcggaagggaggctgttctctgcggaaacggcgcggcggagcttatctttctgattgtacaggcgaagcgtccgaagcgggcgctgttaatcgccccctcctttctggaatatgagcaggcgttaaaggccgcaggatgcgggctgtcctggttcgacttaaaggaagaggaaggctttgccctttcggtaccggagctcctcgcgcatttaaaggaggcagaggcggccggacagcggccggatatcctgttcctctgcaatcccaataatcccaccggatttgcggtagaacgggaagcgctgatccctcttttggagtactgcgaagaatgcggcattgtctgtgtggtggatgagtgttttattgagttcctggatgagccggagcgcttttctgtgatgaaggaactgcggtcgggacgtttctgccggctgtttattctgaaggcatttacgaagctttacgccatggccgggctgcggctgggctacggcatttctctggaccgggaacttctggaagcaatggacggctgtcgccagccgtggagtgtctccggtccggctcagtcggcgggcgaggccgcgcttggggagacggagtatgtgaaccgggcgagggagctggtgaaacgtgagcggagctggctgaaggcgcagatggagggcctggggcttttcgtctacgattccagggccaactatctgtttttcagggatccggcgcaggccagggcccggacgccggaatcccgcagcctctatgacgcctgcttgaaaaacggtgtcttaatccgctcctgcgccaactaccgggggcttgacggacgtttttaccggatctgcgtaaaggacagggccaataatgagacatttatccgggtgctgaaaaaggcgatggaagagagggattagatcaatggcaaaatcaattatgatacaggggacgatgtccaacgcgggcaagagtctgattgcggcagggttatgccgggtctttaagcaggacggctaccgggtcgcccctttcaaatcgcagaatatggcgttaaactcttatataacggaggacgggctggagatgggacgcgcccaggtggtgcaggcggaagccgccggaattaaaccgcaggcggacatgaatccgattctgctgaagccgacttccgactccggttcccaggtcatcgtccacggcgtaccgatcggaacgatgccggcgaaagagtattttgcatataaaaagacgctgattcccgaggtggaaaaggcataccggagactggaggaggagtacgatatcatcgtgatcgagggcgccggaagcccggcggagatcaatctgaagaaggatgatatcgtgaacatgggcatggcgaggatggcggatgcgccggtccttttggtgggagatatcgaccgcggcggtgtgtttgcccagctttacgggactgtggctctgctttcggaagaagagcgggcgcgggtgaaggggctcgtcgtcaataaattcaggggagacaagaccattctggagccggggctggacatgatcgaggacctgtgcggcataccggttacgggagtggttccttatgctgatgtggacatcgaggatgaggacagcctgggacaccatttaagcggaacagaaaaagggaaaaagacgctggtggacattgccgtcatacggctgcccagaatttccaattttacggatttccaggtcttttcctgtatgccggaagtcggccttacgtatgtgaaccgtttgtcggatctgggaaaaccggacctgatcctgcttcccgggacgaagaatacgatagaagatttactctggatgcgggagaacggcctggaggcggcagtgctgaagctggcgtccgccggcgttccggtgttcggaatctgcggcggctttcagatgctgggagaaagcatggaggacccgttcggtgtggagacggaaacctacagagggcggccggtggaagggcttaagcttcttccggtaaggaccgtattcggaaaagagaagacgagaacccgggtgaccggttcctgtgcctctgtgggcggaatcctggaggagctttcgggcatggagatcgagggatacgaaatccacatgggcgagacggtccgtgcggtgccgcccctgtcctatgtgatggagcagaacggctctcatctggccaagatggatggatgccagagaaatcatgtctacggcacgtacatccatggattctttgaccgggagggaatcgcagagacggttgtgagcgctctccttgagaaaaaggggctgaccgcagtgcgaaacgaagagtttcattacgccgcctaccgggagcagcagtacgaccgtctcgcggcagtcatcagagagagctttgacatggcggcggtttacgaaatgatgggaatcgacggcaatcgcatgacggacagcagaaaggaagatacagaatgataaagacggaactggaacgggtgcttcccggtgacatagagaaaaggagctttgagattatcacagaggagctgggggaccgggtcctggacccggaaaatgaactggtcatcaaacgcgtaatccacacgaccgccgacttcgactatgcggacagcttaatcttttccgaacacgcagtggagctggcgaaggcggcgattaaagaaggcgtccgcttcatcacagacaccaatatggggaaatcgggcatcaaccgggcggccctccagaaatgcggctgtacggtggactgtttcatggccgatgaagacgtggcggaggcggcgaagcggctcggaaccaccagagcctgcgccagtatggagaaggcggccgatttgggcggagactgtatctttgcagtcggcaatgcccctacggcactggtccggctgtacgagctgattaaagagggcaggctgaaaccgaaactggtgatcggtgtgccggtaggctttgtcaacgtggtccagtcgaaggagatgatcctttcactgcccgacacgccgtttattgtggcgagaggacggaagggcggaagcaatgtggcggccgccatctgcaacgcgctgctgtatcagtgcatataacgggactgcatagagacaaaatcttattatttacaggagagaaggggtatagatcatgaatttatacagcattattttggtggacgacgaggaagaggtccgcaagagcattatcaaacagattgactgggaatcagccggattcaaggtggtgggggatgccgagaacggagaagacgcgctggaaaagatcgaggtcttagagccggatgtggtgttaaccgatatccgcatgccctatatggatggccttacgctggcggagaaaatccggcagaggtatccttccatgaaggtggttattttttcgggctacgacgatttcgagtacgcccagaaggcgattaagctgaatgtgacggagtacattctaaaaccggtcaacgtggaggagctgacctccatcctgaaacggatcaagtccaatttagacgaagagattgaagagaagcgcaacgtgagccgccttcgtgaaaattacagaaagagcctgccgattatccgcgagcagtttttcaacgacatggtgcaccggaggctgtcggatgatttgatcgagtcgaagctgagggaatatgatatcccgattacgggagccaggaaatgggtgatcgcggccgtcgatgtggaaaagagtgacgacagaagcaagaagacgctgtcactccacgaggaggaagagctgattccgatttccgtcatgcagatcgtgcgggaaaagctgaaaagctactgccggttctccttattccagtccacggctgaagccgaaatggtggtgatcgcggcgctcgacgacgacaatacgacgacggggctcatcgatgttctgggagatatctgtaaggaggccaaacgtattctggaggttccggtcaccataggcatcggccacagcgtgaccggcctgtcgaagatcgcaggctcctatcagtcggcagtggaagccctgggatataaggcggtggtaggcagcggaatcacgatctacatcaacgatatggagccggtaggcagcggcaagctggaatttgacaatgcagacgagtctgattttatttccgccgtcaaatttggtccggatgagaagatcgaggccgtaacggccagaatctccggcaagctggaatcggcaaaggtgcattaccgtcagcagcaggtgtatgtgttcggcgtcctgaacaccatcattcagatgatccagcagtatgacttaaacctggaggagattttgggcggcgagctggaatacttaagcgtcatcgacaagcttcagaagcgggaggagttcggcgagtggctgttaaaaacggcgcacaagatgaaccaggccatcaatcaggagcgtgacataacgacgcgccaggtgatccagcaggcgaagcagtatattatggacaactatcagaaccccgatctgtccgtggagatgatctgccgccacctgcacatgagcccggcttatttctcgaccatgttcaagaaggagacggggcaggcctacatcgcctatctcacggaaatccgcttaaataaggccgtggaactgttaaacaagacggacgacaagacgtacgtcattgcctccaaggtgggttaccaggagcagaactatttcagctacgtattcaagaaaaaatttggagtgtcaccgacgaaattccgtggagccagataaatgaataaaaagaaaaacggcaagaggattcataacaacagcatacggtatacgatctttacgtattttaccgtgactgccctggcggccagtctgctcattacgttttccatctaccagcgtctgtcgagccaggtgtccgagacggttatggaggaaaatcagagcctgatcggccaggtggcgcggtctgtggagagctatctgcgcacggtcatgaagctgtcggattccctgtattacggtgcggtaaagaacgcggacctgtcctcggagtccatcaacagcgagatcaccctgctgtacgacaacaacaaggacaatgtggacaacattgccctgttctcccaggatgggactttaaaggaggcggtgccggcagccagaatcaagacgaatctggacgtaaccggggacggctggttttccaatgccctggagaagacggaaaaccagcatttctccaatcctcatgtccagtatattttcgacggcaatgaaagccagtaccggtgggtgatctctctgtcccgggcggtggagctgacggaagggacatcgacggcacagggcgtgcttttggtggatttaagctactccagcctggcgcatctgtttgagggcgtgaccacaggcaccggaggctacgtctacttaatcagcagcgacggggaaatcctctaccatccgaagatccagctgattgattccggacgggtctccgagaataatttaacagcggcgggatacaaggacggaaaccatctggaaaagttcgaggggcgtgagcggattatcaccgtgaagtccgtgggctacacgggctggaaggtcgtaggggtgacgccaaagaacgtggtatccctaaactccataaagacgaggctgtttatcattttcctgatcaccctgattctctttattttaacaattatcaactcctatatatcgtccagaatcacgaatcccatcaaagagctggaaaaatccgtgggaattctggaggagggaaatttggagacgccggtctatatcggcggatcgtatgagattcagcatctgggaacctccatcaataacatggccagacagatccgggtgctcatgaacgatattgtgacggagcatgaggccaagagaaagcaggaatttgatacgctgcagtctcagatcaacccgcatttcctctataacaccctggatatcatcgtctggatgattgaaaatgagcagaaggcggaggcggtcaaggtagtgacggcgcttgcgcggttcttccgtatcagcctgagcaagggcaagagcatcatcaccgtgcatgacgagctggagcacgtgcgcaactatctgatgattcagcacatgcgttttaagaacaaattttcctactacatcgacgccgcggacgactgcctggagctggccagtttaaagctgatgctccagccgctggtggagaacgcgatctaccacgggatggagttcatggacggcgacggcgagatcacgcttaaggtgtggaaggaaggggaggacttatacttcacggtccgcgacaacgggctgggcatgacccgggaacaggtggaaagcctgttttccgactcgattttagtgacctccaagaagggctccggaatcggtgtaaagaatgtgaatgagcggatcaagctctattttggcgaggagtacgggcttaggatcgattcagaaccggacgaggggacggagattaccatccaccttcctgccgttccctacagccggattctggcggagggcggagaaagatgaagatgacaaagcgggaaaagatgatatggagtctgcttgcgggagttttagtcctcctgtttctgctgtcctccacggatttgattatcaaagaaaagaagacggagatttatccgatatccatcgtgattggagataccacagatgattactacacaaatttccgcaagggcgtggacaaggctgcggatgagtacaacgtggatgtcaacttcatcaccctgtacgaaaagggagatgtcacggagcagatggagctgttaaagcgtgagattgacgacggggcgaaggcggcggtgctggtgcccttaaagcagcaggagtgcagcacgatactggatgggatggtcctcagcagcccgctgatcgtcatgggaaccatcttcccgggcgactgggccatgagcggtatctcacaggactaccaggagactgggaagatgctgggggaagccatagcaagggaaaataccccggacaagccggttctcgtattctccgaggggctggagtacggctacaataaagaagtgtacaaaagtcttctggcggcgctctcccaggcgggcttccatgtgcagctctacgaaaagtacagaaacggcgcttccggcgcccccgcggcggaaagtgaggacgactttcaccggacgattgaagaaaacgcggtttccggcagcggggaggagattctcgtcgccctggacgtgcagagcctggatcaggtggcggatgtcatcgcgggaagcccgctttatggaaaagacactccgaacctctatggcttcggcagtacgacgaagatattaaatcagatggaccgcggcgtgataaagggccttgtgacgacaaaccagttcgatgccggatacttaagcattgtaaaggcagtggaggccatcgaaaagcgcggcgaccgggatcagatcgtgctggaatcgtattacatcgaaaaagatgatttgaaagagacgcgtttcgagaagattctttatccaatcgagtaaggaacagaggagggccaatgaaaaagaaatattcatttattgcagtactgctcatagctgttattcttgtgttcggctgtctgtttttccagaaccggagccatgaggagaaggaggagaaaaagacactgcgggtcggggtgactctgtaccggggagacgattcctttattaataatctctgcggaaagatggaggagaaggcgaaagcctatgagaaggagaccggcgtcaaagtgattctcgacgttgtggatggaaagggcaatcagaacacgcagaacagccaggtggaccggtttatctccctgggtgtggacgtgatctgcgtcaatatggtggaccggtccgcagcctcctatatcatcagcagggcgatggagggcgacattcccgtgatattcttcaacagggagccggtggaagaggatatgaaccgatgggagaagctttactatgtgggggaaagcgccaaggaatccgcggtcctgcaggggaacatcctggtagatgcctataagaaggatcccgcttccctggatttaaacggcgacggcaaggtaagctatgtactccttgagggcgaggcaagccatcaggattccttaatcagaacggaatggtcgattcagaccttaaaagacggaggcgttcccctggaaaagatcaccggaggcattggaaactgggagaagagccagggctctgcgtggatggagaaatggctcgatgagtatccggatgaaatcgaactcgtgatcagcaacaatgacgatatggcgctgggtgcggctgacgcgctggagcggaagaaaatcacaaggcccatcaagattgtggggatcgacggaacaccacagggaatcgaggggctgagctccgggaagctctttggaaccgtgcagtgtgacagcgatgagtacgccaatgtgatgttccagatcgccgctgcggccggacttggacagaatgtacaggaaatcgtgagtttggaagggggaaaatactataattgcagtcagactgcactaacagctgataaaaactaaaatgtcttgtgcatgttgcgatccagaccatggaaaaatgggtaaaaaacataaaatctaagaaattttatataataacgaaaaaaatcatatggaaatatacctaaaataaagatataatatgggtgccgatgaggaaaaaatgacgaatcggcaaatactatactatatctagggaggatttatcatgagattactcaaaaaagtagtagcagtaggtatggcgtccactatggtattttccatggcaggatgtggctccaagacagcagaaacaccaacaacagcagctccggcagagacaacaaccgcagcagcaggagagacaacagcagctccggcagagacaaaagccgctgatgcaaaagtggagaacaaggataagcccttagtatggtttaaccgtcagccatccagcagtgccacaggccagcttgatatgacggcgctgaattacaatgcggatacatactatgtaggattcgatgcaaatcagggtgctgaacttcagggtaccatggtaaaagagtacatcgaaaagaatattgacaccatcgaccgcaacggtgacggaatcatcggctatgttctggcgatcggcgatatcggacataacgattccatcgctcgtacaagaggcgttcgtaaggcccttggaacagcggtagagaaagacggcaacattgtcagtgatccgattggtacaaacacagagggcaaggcaacagccgtacaggacggaacacttgaagttggcggaaagacatatatcgttcgcgaacttgcttcccaggagatgaagaactccgcaggagctacatgggatgcagcgactgcaggcaacggaattggcacatggtcttcttctttcggcgatcagattgatattgttgcttccaacaacgacggtatgggaatgtccatgttcaacgcatggtccaaggacaacaaagttcctacatttggttatgatgcaaacagtgatgcagttgccgctatcgcagaaggctacggcggaaccatcagccagcatgcagatgttcaggcttacttaacacttcgtgttctccgcaacgctctcgatggagttgatattgatactggtatcggtacagcggacgatgcaggcaacgttctgagcagcgatgtatatgtatacaaaacagatgagcgttcttactatgcattaaacgttgctgttacagcagataactataacgatttcatggattccacaatggtttatgcgccagtagcaaatcagctggatgctgctgcccatccggaaaagaatgtatggctgaatatttacaattcagctgataacttcctgggttcaacctaccagccacttcttcagaagtacgacaagctgcttaacttaaaggttgagtacatcggcggcgatggccagacagagtccaatatcacaaaccgtcttggaaatccgagccagtacgatgcatttgcaattaacatggttaagacagataacgcagcttcttacacatctttacttgatcagtaatattcactaatattaaagatgggcaggctatcagggagaagaaattctccctgataacctcttttaaataagcgagaatttccacgcatctgtaagtggaggtctgaattaccaaaataagtttaacggtagtggcgggcggagaaaaatcggtatcccccactgacatgaagttaagtcacgcatcttaaaatgtagtcgtactctgtgaaattaccgagagtggattgaaacaataatcaggtgtttttataagcagaggagtaaaaacaatggcagataagaaagatgatatcgtcttatcaatacgcggtatgagcaagtcctttggccgaaacagggttctggaccatatcaatctggatgtgaagcgcggaaccgttatggggcttatgggtgagaacggcgccggtaagtccaccatgatgaagtgcctgtttggtacctaccagaaggacgagggaaatatcttcctgaaaggaaaggaagtaagcttttccggaccgaaggatgcccttgaaaacggaattgcaatggttcaccaggaactgaatcagtgtctggaaagaaatgttattgacaatctgttcctcggtcgttatccggtcaattccatggggattgttgatgaaggcagaatgaaaaaggaagcttccgagcttttcagaaagctgggcatgaccgttgaccttactcagcccatgcggaacatgtctgtatcacagaggcagatgtgtgagattgccaaggcaatctcctataattcccaggtaatcgttctcgatgagccgacttcctccttaacggtacaggaagtggataaacttttcgagatgatgagaatgttaaaagagcagggaattgccctgatctacatctctcataagatggatgagatttttgaaatttgtgatgagatatcagtgcttcgtgacggcaacctggttatgacaaagagtaccagggatgcgaacatgaatgagctgatagcggccatggtaggccgttcacttgacaaccggttccctccggttgacaatacccccaaggatgtgattttgtccatccagcatttatccacgaagtttgaaccccatttgcaggatgtttccttcgatgtaaaagaaggggagatcttcgggctgtatggactggtgggagcagggcgtacggagcttctggagacgatctttggtgtccgtacccgagcggcagggcgtgtttactttaataagcgccttatgaatttcggaagtgcgaaggaagccatggagcatggatttgccatgatcactgaggaacgaaaggccaatgggcttttcctgaagggtgatctcacgtttaataccaccattgcaaacctggagcagtataagaccggaatcgcactctctgatgtaaagatggtaaatgcgacttcgaaggaaatcaaaatcatgcataccaagtgtatggggccggacgatatgatatcgagcctttccggcggtaaccagcagaaggttatttttggaaaatggctggaacgcgagcctcaggttttcatgatggatgaacctacaagaggtatcgatgtcggcgcgaaatacgaaatatatgagttgatcatcaatatggcgaagcagggaaagacgatcatagttgtttcctctgagatgccggagattctgggaattacgaaccgtattggtgttatgtccaatggacggctgtctggaattgtgaatacaaaagaaacaaaccaggaagagcttttaagactcagtgcaaaatacctataatgggggagattgatggatatggcgaatggaaatggtaagactcttacagctgaacaggaacttaagctgcgccagccaattgaggattatgttggtaagatacagagtaagatcgacagcctcagagcggacggcacaaacagagcagtcgctcttcagaattcgattgacgcaataaagagagaccgcagcatcacgaagggtgaaaaagaatccaggattacagcgtataaggctgagctggataaagcaaaagcagttgaagcaaaaaataaagatgagatttcaaaattaatttctgacgcaacagcgtatctgaaggcacactttgataaggattattatcagccgctgaaggagagctgtgagcaggaaaaggtgctcgcaaaggaaaagtacaacaaaaagattgcggagctggagaaagaacaccagagcatcatgtcaaagctttctgaccatcaggaagtgaaggatgaaaagtatgttcataagaaccggatgtttgatgcgaaaatggatttggaaaaggaacttcagcagatcaaggacagaagacacgcggcatttgtctggcagtatcatctgatcgacttactgcgcatctccaaattcaccttcacggagtccaggacccagaaatgggagaactataaatatacgttcaaccgcagggaatttttactgcagaatggtttgtatatcgcgattatcctgatttttatcgggctgtgtatcgccacgccgatcataaagggagtgccgctgcttacctataacaatattttaaatattctacagcaggcttccccgcgtatgttccttgcactcggtgtagcgggactcattctccttaccggtacggacctttccattggccgtatggttggtatgggtatgacgactgcaaccatcattatgcaccagggcgtcaatacgggtatggttttcggccatgtatttgattttacgggtcttcccatcggtgtaagagttgttttcgctctgtttatgtgtatcgttctgtgtacatgttttaccgcaatcggaggcttctttacagccagattcaagatgcatccttttatttcaaccatggcaaacatgctggtaatcttcggccttgttacgtatgcgacaaaaggtgtatccttcggtgcaattgaaccttctatcccgaagatgattatcccgagactgaatggtttcccgaccatcatcctttgggcggtagctgcaattgcaatcgtatggtttatctggaacaagacaacattcggcaagaatttatacgcagtcggcggaaacccggaggcagctgctgtttcaggtatttccgtattctgggtaaccatgggcgcatttatcctggctggtattctttacggctttggcgcatggctggaatgtgcaagaatggtaggctccggctccgcggcttatggccagggctgggagatggacgcgatcgcagcctgtgtagtaggcggcgtatcctttaccggtggtattggtaagatttcaggcgtagtagtcggcgtacttattttcaccgtactgatctactcccttacaatcctcggtatcgacacaaacctccagttcgtatttgaaggtattatcattatcacggcagtaacacttgactgtctgaaatacgttcagaagaaataaaacaataatccacccaacagcatgaaagaatttgcttatgcgccagcgcaccgcaaattctttcatgccttttttatttcataggaaagatggccgctgaagcgaccgcgctccggcgcggtagtccagcttgccggactctttcttgtaaggagaagaataaaatttctccccaaagcatggtccccaggctcaaagcagctccatacctgccagccccgacaaccggctgttctgatactccccggagtacgtcacatcccttccaaaccattccggaggaacaaacgcattcgcctcctcctccgtctcaaactccacttccgccagcataagcccctgaaacttcccttcaaacacatcgaattcgatagtcaaatgcgatccctcgacaggaatcaagtaccttttcttcgtaagaatattcccatccgccttcccgatcaaatgctcataagcctcctttgtaagaggcagattatactcctccctggccagcttccctcttgacttatacgtaagataatacgtatcatcctcccgtctcacccgcaccaccggctctgtacacaggtaaccctgctcaatcgcatgataaggatactccttatatccgggcagtggatcatttataaaaaatttacgttctatttccatcgatttccctccattaacaatacgtgtaaccattgcaaaaatagtataccatataccataaagaaaatgtagtcaagccttttatttattatttaatattgttttaatattggttttctcagcacagccagtacacagccccagggtttgcggttagggcgagggggacgggggagaacctgcgacagtttccttttccgaggctcgcaggaacttaagccggaaggcaggaaaaaagggtggtgaaatctggcctccaagccagatttcaagtgcacatgtaggagaagtccttcaggagttctccgtaatttgcgcgggccgcccttttttcctgccttccggctttagttcctgccgccgaggaaacaagaagctgtcgcaggttctcccccgtccccctcgccctaaccgcagaccctggggcgtacccctcccaataattgtttcttcccatctcaagctgaaacagtagataaaataccctaaaagtggtaatataaaatctacagacaaaaaacaggagaatacatcatgaaaaagagagaataccgtatttttcccatctgtctgctgctggctctggcggtctgctttctggcggcgtgttcgtccggaaaaggcgggacgcaggaatcgccgggggcgtcgaaaagtacgtccaaaagtacgtcagaaagtgccaatggcagtgggaacggtgcggatgacagcggtgaaagtacggaagcagcggagaagaagctgcggattggcgttgccatctaccggtacgacgataattttatgaagctgtaccgggaggagctgaggcagtatctggaggaagcgtataacgcggaggttgtggtgcggaatgccaggggagagcaggaggaacagatctcccaggtgaatgagttcatcgaggccggatacgacgggattatcgtgaatctggtggacacggaccgggcgggcgtgattgcggattcctgccatgaggccgggattccccttgtatttatcaacagggagccgaaggcggacgagcaggcccgatggaagacggagaagatggcggtttcctgcatcggaacggattcgaagcaggccggaacctatcagggcggcatcatactggagacggagaaacgcggagattttaacggggatggagtcgtgtcctacgttatgatcatgggagaaaaggacaatgaggacagcaattaccgcacagagtattccataaaggcgctggaggacggcggcatgaagacggaaaagctgttttcaggccatgctgactggaataaggaagaggggcggaagctggcagagaaggcgcttgcactctatggcaggcggattgaggtcattttctgcaacaatgacgccatggccaatggcgcgtgggaagccatcgacgcggccgggcggaaaaccggaaaggacatctacttagtgggcgtggatgccctggaggagacggttcagtatatcaaggaaggcaaagtgacgggaaccgtgctgaacgaccacacgggacagtcccatacggcggcggacgtgctgatgaagatgatttacggtgacgaggcagaaacaaggtatctggtgaattatgtgaagatttctaccatcagcaccctgcaaaaataaacagacagagagggttattatcatgggaaaagtatatgcatttgtagcaaacggatcagaagaggtggagctgcttgcagtcgtggatgttctgctcagaggcggacaggatgtgaagctggtttccattacaggaagtaaagatgtggtaagcgcgcatcagataaagctgcaggcggatcttgaattttccgaggcagatttttctgacgcggatgttctgtttttaccgggcggtatgccggggacgaggaatctggcggctcatgagggcttgtgcggggaactgttaaaggcggataaggctggaaagagactggctgccatctgtgccggccccagcgtcctcggcggactgggaatcctggaagggagaaaggcgacgtgctatccgggctttgaaggcgaactgaagggtgcggaatatacgagacagggcgtagtgacggatggcaatgtgacaaccgcacggggccttggctatgcgctggatctgggaattgaactgctggctttattgacggacagggaacatgcgggtcagatcaaagattcgatccagtatgaccagattccaatgtaaggataagtgtgtgatggggatgaagatgaaaaaaagttgggtactgccggttctggctgcggggattttggccgccggcttagcgggatgtgaaaagaaggatccttacggcctctcggctaaggatccggtgacgattaccatatggcactactataacggcgtccagaaggaaggcttcgatcagctggttcagacatttaacgaatcgaagggccgggaaaagggcataatcgtggaagcctacagcaagggcagcatcgacgatttaagccaggccgtgacggacagcatcgataagaagattggctcagatccggttccggacgtcttcgcggcttatgccgataaggtctatgagattgaccagagagacatggcggttgatttaagcaagtatctgaccgccgatgagatcggtgagtatgtggatgcctacatagaagaaggccggtttgacggaagcgaaggaatcaaggtattcccggtggcgaagtcaacggaagtatttgcgatcaacaagacggactgggataagtttgccgaggcaaccggggagacggacgccgcgttctcctcctgggaaggaatcacgcgtgtggcggagaaatattacaagtggaccgacagcctgacggaaacgccggatgacggaaaggcatttttcggaagagacgcatttgccaactatatcatcgtcggaagcctgcagcttggacatgagattttccgcgtggaagatggacacgtgatcatggattttgacaggaccgccatgaagcggctctgggataactactatattccgtatgtcaacggctatttcggcgcattcggaaagttcagaagcgacgatgtgaagacgggacagctggcggccttcgtgggctcaaccagcggattcgcctatttcccaaccagcgtgacgttggaggatggaaccagctatcccatcgagagcaaggtctatccgcttcccaacttctcggggacggagccgtgcgccgtccagcagggcgcaggcatgatgatcttaaagtctgaggagaagagagagtatgcggcgtccacctttttgaagtggtttacgggtgttgacaataatatcagattttccgtctcctccggctatctgccggttaagaaggaagcgggagtgaaggaacggctggagaccgtgctggcggagaacggagaggaagacgcggcaggcgagaacctgctgattggcctggagactgccaacaagtatcagctgtatacgacgaagcccttcgagggcggagatcaggcgcgcgccattttaaacaccaccatggcggataaagccagagaagacagagagaccgtgctgtccctcatggcgcagggaatgtccagggaagaagcggtagagcagtttacggaagaatctaactttgaacagtggtatgaggatacaaaagaacaactggagaccatcatcggagagtagttatgaaaaaaggcaggaatgaatccatcagaacccatctgctctggccgttattggtgctgttgattatacaggcactgattatggccggaatggttctgttcggcggtgtttctaaaaaactgaagaataatgaaatccatattttgagtgagaatacggataacaccaggctctatctggagaaggagacgatccaccagtggattaatgtcgtcaatgactccggatccatggcgtctgagattcagtcggttttagacgaacagcataaagatgcgtcctgtatttcaagcgattatgatttaaaccgggagattgccgacgggattatgaacagagccgtcgatctcatgcgccgcagctacggtacgggaatattcgtcgtgctggatggcccggccgcgcagaacagtgcggaaaatacgaaggccgggttttacatacgcgattccaatcccggcaggagctataatcaggataattcgtccctgcttctggagcgggggcttccttcccttgccaataaatacgggattcctctggattccttctgggacctgggctttgacatgacggccgatgacggcagtaccgatttctataaaaaaccgttttattcctccgtggagaatcaggccggggcagaggaccggttgaattttgcctatttaagcaagccgttccgcctgagtcccaaagacattcctgtcatcacgtattccgcccccatcatcctggaggacggaagcgtcgtgggcgtgttcggactggagatgggaatcggaaggatcgagcaggtgctcagctccgacaggacggagagcagcttcgaggtctgctacgccctgggagtccgacaggcgggagagaataccatcactcccgtagcatcgtcaggctatctttataatcagtatttcaagggagacgagtacctggaatacacggataacgaggaggaaggcatcggtgagctgcgttcctccgaccgggccggctggtatgccagcgtaaagcagctggaggtgtataactataatacgccgtttgaacaggaggaatgggtcctggtcgggatggccaggaagaacgacctgctgtccttttataattccattcgaagcatgctgctgagctccattctgattccgattattttaagcgtattcggcgtcttcatcatcggcaagatcgtgacagacccgattcgcggcctggtcaatgaggttcgcaaacggtcgggagaacacggccttacgctgacacgggttaacatcggagagatcgatgaactgacagagaccatcgaacagctgagtgcggatgtggagcggtctgcatcgaagatttccagcattttagagcacgccaacgtgctgatcggcgtgtttgagtatgaagaaaataatgagagcgtattctgcagccgttccatttttgagatgatgggatgggaagaaccgggggagccgtactgctatatgggcagcgaggagttccagcagcggatggagtccggcatcaggaatacaaagagagacggcgaaaattacctgtttcatgtggaggcgcggccgacggcagatgaagcagagaggatcgcgtctgaccgggcaaatgcggccggtaagggacgctgggtccgtctcatcctggatacacaggaggcgggaacggtcctcggcgtgctctcggatgtgacgggcgacgtggaggagaaggcgaagctggagcgggagagaaattacgatctgctcaccagcctctataacagaagggcattccgggaacagctggtggtggctatggcggatggaaccattcagaccgcggctgtggccatgtgggatctcgataatttaaagtatatcaacgatacgtacggccatgacgagggcgaccgctatatcgttctgtttgccaactgcttaaagcggctggaagaggaaggcgccatcgtatcgcgctattccggcgatgaattcgtcacgctgatttacggggacggcggaaaagaggagatcaggcggagagtccagtccttcatgcagtttttgcagtccaccagcctggagatgaagggcggctatcagattcctgtccgcgtttccggaggcatggcgtggtatccggatgacgccgtggattttgacacactgttaaattacgctgactttgccatgtacatggtgaagcacagcgtgaagggcattatcatggaattcgattccaacgattactctaacaattcctatatgctggccgggcgggaagaattaaaccggatgctggagacgcgggaagtggattttgcattccagccgatcacgaggcgggacggaagcgtctttggctatgagctgctgatgcggcccaattttacgaatttaaaggggatcaaagaggtgctgaatctggcacgggctcaggcgaagcttacacagatggagacgctgacctggtatgccggtctgaaggctgtggaaaaacaggatcaggcgggcgctctgggacagacggaacggcttttcatcaactccattgccagcgcctgtatgtcgaaggaggaggaagccgatctctggaaccggtacagctgctatctgtcccgtattgtgacggagcttacggaaggggaacccgtgaatcaggagtatatgagccgtaaaattgcggtgactaaaaagtggaacggtcttatcgctatcgacgattttggggcaggctacaacagtgaaaccgtgcttctcgacatggcgcccgacatcatcaaggtggacatgagtcttgtgcagcggattcatgaagatcccaaccgccagctgattttgaataatatcctggactttgccgggcagaatcatatcacggttctggcagagggcgtggagacgaaggaggaactggaattcctgattcaatgcggcgtcgagctgttccagggatactatatcggacggcctcagatggaaatccgtccaatcgatccgtacattgtcaggaaaatgcaggattttgcccaaaaatcggacttttcacagaaatagtactggaatttaccgaatgagtatgctataatgctaaattgaagtgtaacgccctgtcggtatggcggttcacatatatattcaaggaggaacccatagaatgagtttacaagtagagaaattagaaaagaacatggcaaaattaaccgtagaggtaccagctgaacagtttgaaaaagcgctcaccacggcttttaataagaataagagcagattcaacatacctggcttcagaaaaggaaaagctcctcaggccatggtagagaagatgtacggcgtagaggtattatatgaggatgccatcaacgaagctctcgacgcaacatacggcgatgccgtaacagagagcgaactggacgttgtatccagacctgaaatcgacgttgtacaggttgaaaaagggaaagaattaatctacacagctaccgtagctgttaagccggaagtgactctcggcgagtacaaaggaatcgaagtagagaaggcttccgctgaagtgagcgacgaggacatcgaagcagagcttaagaaggttcaggagcagaactccagactgatcaccgtagaggacagagcagtagaagacggagaccagacggttgttgatttcgaaggatttgtagacggaactccgtttgaaggcggaaagggcgaggattatcctttaaccatcggttcccattccttcatcgatacattcgaagagcagttaatcggtaagaacatcggcgaagagtgcgaagtaaacgtaaccttcccggaggaataccatgcaaaagaacttgccggtaagccagcagtatttaaggtaaccgttaaggagatcaagagaaaagagcttccggagttaaacgatgagtttgccggagaagtttccgaattcgagactctcgaagagtacaagaacgatgtaaaggccaagctttccttaacaaagcagaaagaagccgctacagagaatgagaatcatgttgttgacaaggtagtggagaatgccacaatggacattcctgagccgatgatcgacagccaggtaaacaacatggtcaacgattatgcaagaagaatgcagagccagggcctttcccttgagcagtacatgcagttcaccggcatgacgatcgatactttaaaagagcagatgaagccacaggctgttaagagaattcagacaagactcgtattagaagcgattgtaaaagctgaaaacatcacagtttccgatgaagctgttgagaaagagatcgcagacatggctgaatcctacaagatggaagttgcccagatcaaggaatacatgggagagaacggcatcgagcagatgaaggaagacctggcagttcaggaagcagttgatttcctggttgctgaggcaaagttagtttaattaatgtggattttctgtcattagtggtttatccccacttttggaggtcaaagcggtctgagtaatctggcagagtagttataaatagctttgtcatgctgagggtgaattacaaacctcagcatgcggattgtaataattacgtttagaagaccggggagattcctgactatgtttggaatctgctcggctttcgtaatataagaacggcagaccagaattcgcaacgaggaggaaacaatatgagtttagtaccttatgtcattgaatcgacgagtaagggcgagcgttcttacgatatttattcaagactcttaaaagaaagaatcattttcctgggtgaagaagtgacggatgtatccgcgagcatcgttgtagcccagcttctgtttctggaggcggaggatcctaacaaggacatcaacctctacatcaacagcccgggcggctccgtaaccgcgggtatggcgatctacgatacgatgaactatatcaagtgtgacgtttccaccgtatgtatgggcatggcggccagtatgggcgcattcttactgtccggcggtgcaaaaggaaagagattcgctcttccgaacgcggaggtcatgattcatcagccttccggcggcgcacagggacaggcgaccgagatccggattgttgcggaaaacattttaaagatcaagaagcgtttgaacgagatcctggctgcaaacacaggccagccgtatgaagtgatcgaacgcgatacagagcgcgataactacatgaacgccgaagaagcaaaggcttacggtctgattgatgaaattatctacagccacgagcattaagttagtgattaattgagaaagaatgaggtgtgtatatgccggtcagaacagacgacaaaatccgatgctctttttgcgggaaaacgcaggaccaggtaaagaagctgattgccggttccaataatgtctatatctgtgacgagtgtattgatctctgcgcggagatattagaagaagagttcgacagtcatgaagaagaaggacctgatttcagcgacatcaacttaatgaagccgaaggagatcaagtcatttctggatgactacgtcatcgggcaggacagtgccaaaaaggtattgtccgtagcggtctataatcactataagagaatcacatccagacgaaacatggatgtggatgtacagaagagtaatatcctgatgctgggaccgaccggttccggtaagacgtatctggcacagacgctcgcaaaggtgcttaacgtaccgtttgccattgcggacgccacggcgcttaccgaggcgggatatgtgggcgaggatgtggagaacattctgctcaagctgattcagtccgcggattacgatatcagcagggctgagtacggcattatctatatcgatgagattgataagattacgaaaaaatccgaaaacgtgtccatcacgagagacgtgtccggtgaaggggtgcagcaggcactcttaaagattctggagggaacggtcgccagcgtgccgcctcagggcggaagaaagcatcctcatcaggagcttcttcagatcgataccaccaacattctgttcatctgcggcggtgccttcgacgggctcgagaagatcatcgagagccgtttaagcgcgggctccatcggtttcaatgccgagatcgtggataagaacagaaccgatatcgacgacctgttgaagaaagtacttccgcaggatctcgtaaaattcggtctgattccggaattcatcggccgtgtgccggttaccgtgtcattagagcttctcgacaaggcggcgctggtaaagattctgacagaaccgagaaacgccttgatcaagcagtatcagaagctgtttgagctggacgatgtaaagctggagctgaccgaggaagcagtcgaaaggattgcggagctggcagtggagagaaagacgggagccagaggtctgcgttccattatggaaagcgtcatgatggatatcatgtatgagattccatccgacagcaacatcggtatctgtacgatcaccaaggctgttgtgaataaagagggagaaccggagatcatctacagagatacgacggtacccagaaaatccctggcccagaaactgagaaaagataagacaggcgagattgcataggatccagagaaagttcggaaaggtgttacagcaggaagaactgctgcagcacctttccttatttccgcgtgcagtaagctagtacagcgttgcataagttccggtgaattctgcactcgctattcacgccaggaccacgcccacgaagctagacgtaggatccactacgccgtcgcttcgcggacgcgcccctgacgcaaatatcaagcacataattcaccgaaacttacgcaatgctgtactagatggatccatctgtcctgtcgggatgcaaaggagagaaatatggaagataagacaataacgatgccggtcattgctttgcgtggcatgactgtccttcctaaaatgatgatacatttcgacatcagccgcagcaagtccatcgcggctgtggagaaggcgatgatcggagaccagagagtctgtctcgtcactcagaagaacagtgaggaggccgatccgggagtcgacgagcttcaccaggtgggctgtgtggcactgatcaagcagctggtgaagattccgaataacgtggttcgcgtcatggtcgagggacaggagcgcgtggagcttttgggactggacagcgaggaacccatgcttgtcggtgagatcggaaccttaacagagtcggaggattccctggactacgtcacgagacaggccatggtgcgaattctgaaagaaaagctggaggaatacggcaaggagaatccccggatgctgaaggaggtcttcccgaacctgatgatggttacggatctaggcgagcttttggatcagattgcgatccagcttccatgggactacaagaaccgccagaaggttctggagtgtgtacttctggaagagcgttatgagaccgtcatgagaaatcttctgaccgagatcgagattacccgtgtaaaacgggagatccagggacgtgtcaaggagaatgtggataagaatcagaaggactatatcctgcgggagcagctgaaggtgatccgtgaggagctgggggaggacaacccgctgtccgatgccgacgagtatgagaagcagcttaaggctttaaaggcggacaaggagacgaaggacaagattcacagagagatcgaacggttcaaggccatgccgggcggaagccaggaggccaacgtactccgcatgtatctggagacagtgctggatcttccgtggaaaaaggtgtcgaaggacaataacaacatatcgcatgccgaggagattttaaactcggatcactatgggctggaaaaggtaaaggagagaatcctggaatacctggccgtccgtgttctgacgaagaaaggaacgagcccgattatctgccttgtgggacctccgggaaccggtaaaacgtccatcgcgcgctccgtggccagggcgctgaacaagcagtacgtccgcatcagtcttggaggaatccacgacgaggcggaggtccgtggccacagaaagacatacgtcggcgccatgccgggccgcatcgtggaagccatgcggcaggccggagtcagcaatccgctgatgcttctggatgagatcgacaaggtgagcagcgactataagggagatacttcctccgcgctgctggaggtgctggacagcgaacagaatgtgaagttccgcgaccactatgtggaactccccatcgatttgtccgatgtgctttttatcgccacggcgaatacgacgcagaccataccgggaccgctgcttgaccgtatggaagtgattgaagtaaacagctatacggagaatgaaaagttccatattgcgaaaaactatctggtaagaaagcagctggagcggaacggtctgacggaagaacaggtttccattaccgacaaggctcttgagaagattatccataattataccagggaagccggagtgagaaatctggagcgccggatcggggatatctgccggaaggccgccagagagttcctggaagataagaagaaggccatcaggattacggaaaatgggctggaaaagtatctgggtaaggagaaaatcaccttcgaggacgtcaatgaggaagatcaggtgggaatcgtcagaggactggcgtggaccagcgtaggcggagacactctgcagatcgaggtcaacgtcatgcccggcaagggaacgatgcagatgacaggtcagatgggcgatgtgatgaaggaatcggcccagacggcattaagctatatccgttccatctgcccggagtacggcgtggcggacgattactttgaaaaacacgatatccacctccatattccggagggagcagttccgaaggatggtccgtcggcaggcattaccatggcgaccgccatgctgtcggctgtcacgggaagaaaggtggatgcgaagctggccatgacgggagagatcacactgcgcggaagggcgcttccgatcggcggcttaaaggagaagatcctggctgccaggatggcacatatgaagagagttctcgtgccggataagaacaggcccgacattgcggagctgtcgaaggagatcacgaaggggctgaccatcatttttgtgaaggatatggcagacgtgctgaaggaagcccttgtaagcgaatagaaaggaagccatatgataatcaaaacagtagagctggagaccgtgtgcggaattaccagtaagctgccggacaatacgaagccggagtttgcatttgcagggaagtccaatgtggggaagtcgtcgctgattaacgcgctgatgaaccgcaaggcgtacgcgcgcacgtcttctcagccgggcaagacccagaccatcaatttctacaatatcaacgatgccctttattacgtggatttaccgggctacggctacgcaaaggtagctcaggaggtaaaggccaaatgggggaagatgattgaaaactatctccaccagtctcccatgctgaagcgtgtgttcctgctcatcgacatccgccatgatccatccgtcaacgacaagaccatgtacgactggatcgtgtacaacggatatcagccggttatcattgcgacgaagctggacaagatcaaccggagccaggtgcagaagcatatgaagatggttcgtcagggactgggaatcggccaggatgtgacggttatcccattttccgctgaaacgaaacagggaagagacgaaatatgggctctgatcgaggaaatgatgggagagtcttgacaaggagacaaaatctttttataatgaacctatttatgagatagtgcagaggagaaaaagttatgaaaaaaacaggaaagagtttggcagcagccagccttgcggtggttttagccgtatcggcgctgactgcgtgtgggagcaggaatgcggcagagagtacgccggccgccggagcagaggcgaatggaggcggagagaaggtattgaaggttgcgatggagtgcagctacgcgccgtataactggacccagcctacggatgccaacggcgctgtcgcgatttcgggaggctccgattttgcgtacggctatgacgttatgatggcgaaaaagatcgctgatacgctcggctataagttggagatcgttaagctggactgggattccctggtaccggctgtacagtcgggaaaggttgactgtgtcattgcgggacagtccattaccgctgagcgccttcagtctgtagattttacggagccgtattactatgcgacgatcgtaactctggtaaagacaggcggaaagtatgagaacgcggccagcgttgcagaccttgcaggcgccaccgctacctctcagttaaacacaatctggtacgacaactgcctgccgcagatcccggatggcaacattcagccggcacaggagtctgcaccggccatgctggtagctttaaactccggcagatgtgatctggttgtgacagacaagcctaccggacaggctgcactcattgcgtatccggatttcaagctgcttgatttcacgggcacggacggcgagttccaggtatcggatgaagatatcaacatcggtatttccttaaagaaggggaatacagagttaaaggacgccatcaacagtgtattggctacgatgacaaaagatgattataataagatgatggaagaggcgatttccgttcagccattatcagaataatcttacattacagaaatcggcagggcatgcaggcacgggacagggcagtttcattccgtgccgcttgttctgtttcaattaaattggaggtaatcttatgtcgctgccgtcagatttttttggaaggattgtatttatcctgcagaaatacggagtatcatttttaaacggcgccggaaagactatggcgatcgcccttgtcggtacactgatcggctgtatcatcgggttcgcggtcggaatcgtccagacaataccggtggataagaaggataatcctgttaaaaggggagttctgggacttatcaagctgatcttaaatatctacgtggaggtattccgcggaacgcccatgatggttcaggccatgtttatttactatggatcttccgttctgtttggttttaacatgtcccagacgtttgccgcttactttattatatccattaatactggtgcttacatggcggagacggtgcgcggcggcatcctttccatcgatccgggacagacagagggcgcgaaagccatcggtatgaatcatatccagactatggtcaatgttatcatgcctcaggcgctgcgcaacatcatgcctcagatcggcaataacttaatcattaacatcaaggattcttccgtgctttccgtgatcggcgtcgtagagctgttctatgcgacgaagggcgtggccggcgcttactatacgtattttgaggcatttaccattacgatggtgatttactttatccttaccttcacctgctccagaattctgcgttactgggagaagaagatggacggtccggacagctacgatctcgctaccacggatacgcttgcctacaccagcggcctggtgaaattcccagatccaaacgagaaggaggataagtaattatggcaggaaatacagtactggaaatccatcatttaagcaagacgttcggaacgaacgtggttctccgggatatcgatttctccgtggctgagggcgatgtaacgtgcatcataggcgcctccggttccggtaaatccacactgctgcgctgtatcaaccttctggagacaccgactacgggagagatcctgtatcacgataaggacatcaccgacagaaagatgaacgctgcatcctaccgtacgcgcgtgggaatggtgttccagaacttcaacctctttaataacatgacggtgcttgacaactgcatggtcggccagatcaaggttttaaagaaagataaggaagaagcaaaacgtaaggccatgctttatctggagaaggtaggaatggccccctatatcaacgcgaagccgaggcagctgtccggcggccagaagcagcgtgtggcaatcgccagggcgctcgccatggaaccggagattctgttgtttgacgagccgacgtccgctctggacccgcagatggtgggcgaggtgcttgccgtcatgaggacgctcgcaaaagaggggttgaccatgattatcgtcacccacgagatggcgttcgcccgcgacgtttcgaaccatgtcgtctatatggcgggcggggtgatcgaggaagagggtgctccggcggatatcttcggaaacccgcagaagaactcgaccaaggagtttttgaaccggtttatgcaggggtaggcggaggaaataacggatagtcgaaacggtataaaagttcatatggaaggtttgtgttggaagccctgcaaagtctggtgattttgcggggcttttattttatttcgcaccattaatgcggcagaaatgcggcagatatccgaatattgtggtaccagtatggaagcactgacatcaattccacaggattatgaagagatgaaggtgttccatgtttttatggggcaggtaaaaacccggtaaagcaaagcagtccatacaggatatagatactttgattgaattgatcctttttcatgataagatcagagaaaacggcaagatgatgagagaggagtggactgatctttaatggggaatgttttagataatagcctttatatgaatgatcaaaagaagttccaggaactgttccaagctgtcatacagttcaatagcctgtacaatggaaataatattatacaggatgatattttctcagtgttgactaattacgcacgaaaaaaacaggaagacttggatctttttcggtttcctacaaaagatgatgatttttgtgcacttacatgcgtacagaaaggaagattggtgttttttagagaaaaaaacggaagtgttttaagaaagggctctattttaaatgcggctgttatggatgaagacgtaaaatgtaaagaagatctggaagcgaatgcgttcgccggattacttcttgttccttccaatgctttgtatgaacaaatgcagatttatggaattcccaaatccggtcaggtgttgggcgatatgatcagattaatggcaatttttttcagttccatataaagcaattttactgcggctttatgaagacggatatataaatacggatactgtttacgaatttttaaatgtgaaaaaggaagtactgagaaaagcggtcagctatgaacctgacgctgaaagatggcaaagacgtaccccggagattctcaggtttgggagccttaagcagctaatggatcaaaattcagaatatgatttactgtctgacaagagaaccgtatcagatcaggaaactctctgtaagattttgcacagatatgaagctgccaggagatagcgaatatgcaaaagacaaggtttgctttattggatacagattacatttctaaactccatataacccgaaaagatgatgaaaacagattgatcgatagaatgttggaattaccggagtatcaatttatctgccatgagcagattattctctcattatgctactatatcagaattatggaaagagtgctgtttccctgtatctttcatacttaaaaaatgtctgtgatttgtttgacaaagatttttacaggagattttacatgagccttgaactgtacattaaaatgccaatcgactattttatgatagagattgccaattgtgatatgacagtaggatatggcaacaatctgggcgagattaaaacttacctaatgcagcaagttcttcaaaatcaggatcatatacagttatatgtattttgctcagacgataaaggcgcacgagctggtatttcaggtactaccggaattccctgtatcagtgcaatatcatccttttactaaaatggcagcatagctactatgtcattctgggttttgtattctgaactcagaatgtggattgaaataaaatacatagaaatacaaaagagatgcataaaaaatagttattttcccagctggttatggtttctctacaagctgaaaaaggcttggttactgggttcctgataaaatgagcctatacgaaagtagcaaatagtgtcctatttggtgcccaaattaaaataagagtttgtgagaacccttaaagcgatttatctaagcttgacagaattgtattgaaaccgtagaataaaataaatattaggaggaaatgcgatgaaatttagcgactatttcaaatctgttccgattattaacaccaataggcttatattacgtccgttcactcgtgaggacataaatgagtatttggcatttgcctttaccacagaggtacagcgttatttgggcggaggaatactcagttatgacaacgaaaagcacatttcaaattggttaaacaacatcaacggtaggcttttaaaatctaaaactgtttttacgtggtgtattgaatataaagtcgacaagaaagtggtcggcagaattgacttgggaggattcaacaaaaaatcaatggcagaattggcgtaccacttttcaaaagattattggaacatgggatttgccaaagaagccatcggggaagttgtgcgttttggtatcgaggatctgaaactgcaccggatacaggctttggttatgccggagaatatctactctattaaagcgttaaagaaattgggatttacggaagaaggactattgcgaaaatatcctttcggcaaagagttccacgatgccgtcatgctggcatttgtcatagaagcgaacttgggaataaataattaggggggagcaaaatgaaagggaaaattatcatcctaaatggaccttccagtgccgggaaaacgaccttagcgtatgctttgcaagcagagcttgacgaaatttattatcgtttgtcggcagacgattttatgaagatggttgaccgacaaaaaatgcacgataacttttttgttcgacttggcgaaacgttgactataatgcaccacacaataaaactgttttcagattggggacttaatgtaattgtagaccatgtgcttcttgaaacgccagaagaaaaatttacgactcctgaaattgtttcactacttaatcaatatcctgtgatgtttattagagttgactgtgatttgctagaacttgaacgccgtgaaagagaacgtggcgacagacaactagggcaggcaaaatggcaacttgaaaatatgcacagtcacgatacatatgatttgaaaataaacacttttagacaaaatacaaatgaatctgttcggcaaattgcaaacctgttaaatcaaccagacaaatggagtgcatttaataacttatacaagcgttttacaaaatgaacacttggcgtagtacgacctttttaccgtttataatagtggcaagcagtgtatgagtgtacacactcatacgattttctcaatttgtgtaccactcaaattgaaaaaatccgcttgttggaggctcaccccccaaaattccctgtgaacctcccttgacggggtggctccgctccttgcggagctatgaaaacaggtgacctatccgtggccttaatgccgacgtttaggccacccggaatggagcgtatatccctgtttacaaacccgtaaaaggcaaaggcgatactttgtacctctcccctcgaaaacgtacttctaatgttccgcatataccagctggaaagaaaaattgtggtgcccaaaatggtgcccgactggttctattaccttgtaaagagctatgggatgaaaatcgtcggatataaaacaacctagattccgtgcgggtttacagggtatcttataaaacaatgcaaaaacttttaagccgttttttcggctttaagcaataaaaaatggtaatctgaaaatggtataaggagcatgtggatatttccaatccccaatgctccttataccatttttgtatgactctattcagatacagtgacagattccgttaccacaggaaccggcgttataatttctttttctaccggcgtcataactgccggaaccggaacggctggttttaacggctccggttccggaggcgtttgttcctgtgtctgttcctgtgtctgcccctgtccctggctcttagagacctgcacgttctccgtgcccttcgaatctctgggctttttggaaaagatatctctgaccttgatgcgtacaaaggttttgataaccttcaccgaaagcaggatgataaagacgggaaggacaatggtcagcagtagctttgccttcaaaagaaatttcttccgtttcagctttttcacttctgcctgatactcatctctgatttcctgaatcaatgatttctgttttttgatctgcatgggaattccccctttataatcgcctttttagtcgctcatgagagccttcatggcaaatgcgtagatttcctggctcttggccttccagtggtcacacatgatttccgcctggtccttgtcggggacggcgagctctaaatcgatcagacagctcttaccctcacgcacctcacagtgaacgatgaaatcctggttggtggatttgtagaaatccgcggtcacgcccacctcgttgcggaggcggaacttgttctctttcaaatattcatcgatgtcttcaatgatggcagaggatatcttgttgccgaagaacgaaagggtttcttctccctcccgcgtgatctcgtagcggctgctgttgtggttggtctccacatggaggagcttggcctccagaagttcgtttaatgcctgattcagcgtgaaatacgtggtgtattcatgctccaggaaaaaatttgacagctgcgcactggtaaggggaaaattgacctgcttcagcatatacaaaatcattaatttataaagcgtcatgggttctgacaacataggacaccctccatagattgattcttacttttgtatatgatctttcactgcacggctgaccacatcggccacacggggatcaaatgcctccggcagaatatggttttcatccagtatggattcatccaccagccctgcaatagcggtggcggcagccagcttcatctcttcagtgatcgcagtggcacgtccctctaaagcacccttaaagatgcccgggaatacaactacattattgacctgattggggaaatcagacctgccggtgccgataatttttgctccggcctcttttgcgacgtcaggcataatctcaggaaccgggtttgccatggcgaacaggatcgcatccgtgttcatggacgcggccatctcttttgtgacaattcccggtgcggacacgccgacaaagatatcggcgcccttcatggcatcggccaggctgccgtctgcgccttctaagttggtcacctccaccatcttttcctgcatccagtttaagccgtccatgcccttctttaagattccggcgcggtcacacatggtgatgtgcaaaaatccgtaggttaagagaagctttgtgatggcgattccagcggaaccggctccgtttacgacgacccggcagtcttccttcttcttgccggtcacctttaatgcgttgatgattcctgccagaacgacgatggcggttccgtgctggtcatcgtggaagacggggatggggagcagctcttttaagcgttcctcaatctcaaaacatctgggcgcggaaatatcctctaaattgattcctccgaaagcaggagcgatacccacaacaatctttatgatctcttccgtatcctgggtatccaggcagattgggaatgcgttgacgccgccgaattccttgaagagcacggcctttccttccataacgggcatggcggccagaggtccgatattgccgaggccaagaaccgcgctgccgtcggaaacaaccgcgatcgtgttggatttgattgtatatttataagcggcttccggttcggcagcgatgaccttacacggctccgcaacgccgggagtataggcgagggccaaatcttccctgctttttacttcggccttggaaatagtttccagcttgccgttccatttttcatgcaataataaagctttttcattcgttgtcatgattcttgtccttcttctatcagtttttattttatcataccaattttagggttttaaatcaatagaaaatatgttagaatatagtaattaaactgaaagacaacagctgtcaggctgaagaacataagatacaggtggtactatgagagaacgaatcaacaggctggctaaaggcatcatcgattcggaggttcctgtgatcaaggtcactccgaaaggaattgacgacgtggtgcgttccggcggggccacgaggcgggaacttgtcgttaccagtgagaataatctgcatataaaaggacttgcatattcttccaatttccgcgtgaggcttcttaatggggcgtttggcggcacctataaccatctggtctatgaggtgaataccggttttctggaagacggagatatgattaagggagctttctatctggttaccaatggcggagaaagagaagtcccttattcttttcgtgtggaactgagtacgtcagggaaagcattgagcgatttaaagacggcggaggatttcgccggaacagcgaagaacgactatgagacagcgcttcgcttatttgaatatagagattttttcgaggcccccttcatgaaggatttgcatgtgagggccctttacggtggtttaaaaggaagaccggacaggaagaaggagctggaggaattcctgaccggactcggtgtcaaggagcctgtaaagctgactgcggacgagagcgagcggcggtttgaccaactggacggagtgatccaggaatgtattacgataaccagaagcggttggggctacgtaagccttgaggttacggccgactgcgattttatagagattccggtgagaaacatcggagaccaggattttaccgacgacacctgcgagatcgtctaccgcatccatccgaggcgcatgcatcagggcctgaaccagggatgcattatcattaccggaatcgaagagcgcttcgtcgttccggtgaccgcgatggtgaacccgggcggcggtatttccgcggaggacgcctatacgaaggaagcggtggcgacgtacctgcacctgcgcttgcagaaagaggcaggtaatggggactttcctcacaatccgccgaacacaggtgatggagactttccgcataatcagatgctgcgggcgctggatgagatcgaggagatgaaggggcagcaggaggcgattaagctattaagggccgagatatacctttcagacgacaggacgagccaggcggcgctgctgctggatgaatgccgggagaagatcctggcggagcggcaggagaagctggagctttactgctactatcagtatctgaggctgattctgcagccggatgaataccagaaggaatcgctggtacgtctgctgagaaaatatctggaggagaatccggaccttcataatctgttcctgatccttttaaggctggaccgccggcttaatgagaatccgggcggagccatatccatgatgagacgccagtttgaagcgggcatgagaagcccgtttctctatctgcatgcctgcaggctgctttccgaagagccggatctgatccggagtatcggcccgtttgagctgcaggtactgtccttcggtgccagatacggcgccgcgggagagaaatttgcgctggctgcggcgaggcttacgctgacgtccaggcattttaaccgtcttcactacagggcgctgggacgcctgtatgagaagtatcccggaaaggaaatactggaggcggtctgttccatactgatccggggagagagcaggagtgcggaggcatttaagtggtatgagaaggggatcaaagaaggaatcagcctgacacggctttacgagtattatctgtacgcgcttccaaaggattactgctacctgcttcccaaggaagtgctcctctatttttcctacggcggtagcgagctggaccgccacagcagggcgctgctctataaaaatgtgctggtttacttaaaggaatccgatccgctgtatgaggtgtatgagcgggatatcgaaaaatttgccacagaacagctgttcgaatcgaggatcggaagtaatctggccgttatttacgaacacatgatctacaaggatgtcattgatcttcctatggctaaggtactgccctctattctgcgttcttaccgcgtggagtgcaggaaccttaagatgaagtatgtaattgtctgctacgaggagctgctggaggaggacgcatttcttctggacgacggcgtagcgtacgtgccgctgttttccgagcacagcatcctgttgttccaggatgcctttggaaaccgttacagtacggttccttatgagaagacgccggtgatggataagccggagttagaggcgcgctgctttgaactgtatcccgatcatccgatgctcagactccgggcctgcgacgagatcctaaagaggggcattgcagatgagaaggaggcggggatgctggaggatgccatggaggatggacggctccagccgctgtatcagagactcctgctatccagaatcatagagtattaccagaatatgccgggcattccatcgaacgtgaaagagggagactctcctcttcatccggtgagtgaagacagcacagagggaggcgcttatctggtgcgcctcgacaagcgtctgcttacgaaggaagaacgcctgggaatctgtgagaccttaatcaaccgcaattatgtcgaggaagccttcgatatgatacgggaattcggctgcgaggagattcagagcaagcggcttttaaagctgtgtaccaagatgattcttcagaatctttttgatgaagatccgctgcttctccacctgtcgtaccgcgtatttctggaaggcatgagcgacagcgtcatcctggattacctctgcgagcactataacggtctgacgaatcagatgtaccgcatactcctgcagggtatttccgagcatgtggagacgtatgatcttgaggagcgtctggtcgcacagatgatgttttccggatgcacggaaaccatagaccgggtattcagtctctatatgaacaaaaagaagacgagtgacaacatcgtccgggcatattttacaattaagagttcggagtatttccttgatgacaagactccggatgacaaggttttcgcctatctggaaggcgcggtcaacggctctgcagacaaagacaggataccgacgatctatctgctggctctgaccaaatactattccgagctttcctcgctggaagaggagcagaaggagctgttaaagatcacgacagcggttctcctggaggcgggactggtattcccgtatttcaagaagctggcgaaatacgttcccatgccggaggatatcatggacaaggccatgatccagtatcattcagacaggaacgcgcggatcgattttgaggtccggattctgccggatgaggaggaataccactgcgaggatattggaaggacgtaccaggggattttcgtaaagaagaaggtcctttttgaaggggaaatcatggagtaccggatcagtgaactggaagacggcaagtgggtgctgaaaaaagaaggaagcgtcagctgtgacgctgcatcggcggccggtgattcggaaagcagatttgcctgtttaaatgaaatgagcctgtgtctgagtttaaaggacgaagaagggctcaaaaaacggatgcgggagtatttaacaaagaatgctgccgcggaagaattatttccactgatgtagataaggggattgtcgatggacggattgataattggacttgatttatgtgatgcctataccaggctgtgctgtcacgaacgtgaaaagacgtggtgcctgccgacggtcatctgccgaaagaaggatgatgacgagtggtatgtgggggaagaagcttacgcatacaccctggtgggggaaggcattatcgtagacaagcttataaagatggtcatgaaggacggtaccgccacgctgggaggcgtgaaatacgagggtaccaccctgcttaagatctatctaaagaaaatactggcgctggccagggaggaatttttctccgatgaggtaaaggagctggtgatcacactggaaaaggtggaggtcaagctgatggacgcgctgatgtactgtgcggattacttagagatccccagggaccgggtgcacatcatcagccatacggaaggctttgtctactacgttctgagccagaagaaggaagtatggagcaatcaggtagcggtcttcgatttatcagaggattcgctccattaccacgaattaaaggttcagcgcgggatgaagcagatgactgtggtggccgaggatgaggcgctggaggaaagctttaatctcgatattttgaataccccttccggcggaaagctggcggataagatcctcagttcctgtgcggagcggctgctttccaagaagctgttttcttccattttcctgacaggaaaaggctttgagcggcaggactgggcgggagaattcatgaagcttctctgttccaggcgaaaggtctacatggaccaggagctgtttgccaggggcgccgcttttaagggcatggattacctccatgaaaagacgtcttacccctttatctgtgtctgcgaggggcggcttcattcgacgatatcgatgaaggtgctgcacaagaaccgtgagagccagctgatcgtggcggctgccggcgacaactggtatgagtcgagaagcagtgtggatttgatcgtggataaccaggactacgtagagtttttagtaacacccatggatccgaagcagaaaaagctggtaaagattccgctggagggattcccgaaacggcccgagagaacgacgcgtgtggggatcagcgtgggatttttagatgagaagacgatggcggtggtgcttaaggacaagggcttcggagaactgttcccggcctcagatgccgtagtcagacaagaggtcatgatatgagcctgatactatgccggcaggagccggtaaaacatcctttttatttcgagggcctgggagtccacctctactcctcccaggagctttgctatgtgatctaccataatccgctcctggtactggagactttcgtggatgaccatctgatcgaattcatccgcggcgagctggagatgggctttatggcggccaagctggaaaaatggcagcagagcggagaagacaccgatgagctcctgtttttaatcctgacggaatgtgactactacaacgcagccgagatcaaacatttccgtcaaaagatcgagacctacagaaaaatgaccccgcccgaattcgccaaagccaaagccgactacctcttcacgagaaagcagtacggcaaagccgtagcagaatacgaaggaatcttagagatgccaaaggagtcttcaacagacgacgccttttttgcgaagatatacaacaatctgggagcttcctatgcgcgtttattttccatggagaaggcctatcaggcgtatcagaagtcgtttgatttagcaaagagtggagacgtattaaagcgaatctattatttatccaaatggaaccccaatctggtattaaaagacagataccgcacattgattacggaagatgtaaaagcggtatgggatgaagatatgaagaaggcagaagaagcagcgcagaaggttgaaagcttagaaaaattagacgaactattcttaaaagatccgattaaaagaatgaaaggtgcttccgaactggtcaaaggctggaagggagagtaccgaaacatgatataagcactgagcagtgcgaaaaaagacatagacaaatttacgttgtgcttgcacaaaagtaaatttgtctatgtcttttttcatagggcgaacgcccgtcagcgagatggagcgaagcggaatcgagcggccactgcgggccagcgggcagcacgatcaatttcatataaacagggcagttctctcttgacatcttctctgccatcaagtattatatagataatcgatatatatagatcacctatatataaatcacctatataacaactcaaaaaaaagaaagtgaggtacccccatgcccatcgacaaaagcctgatctcaggcagtaccaccatgcttcttctaaaacttctaacagaaaaagacatgtacggatacgagatgatagaaaatctgcggaagaaatccaacgatgtattcgaactgaaagcgggaaccctgtatccgcttctgcattccctggaacagaagggatatttgacctcctatgaagaggacgcttccggaaaggtacgcaagtattacagtatcaccggagagggaaagcgttacctgaaagggaaagaagaagagtggaagcaatatgccggagcagtatccggagtactagcactgcattgcataaatctctgcgctatagtaccagctatctacgccaggagcacgcccgcgaagctagacgtagggtccactacgccgtcgcttcgcggacgcacacctgacgcagatatcaggcactataactcagctatttatgcaacgcagtactaggaggtgccgtctatggaactaactgaatatctcgataccgtatcggagcagatccgctgtaaaaaggccaggatcatggtcagggaggagctggaaaaccatgtgcaggaacagtctgatgcctatgaggctgatggcatgacgccttctgaggcgaagagagaggcggtccgccagatgggagatcccatagagacgggaactgccctgaaccggattcaccggccgcatctggagtggaaattcctcattctggtgcttctgttaagcgcgttaggcctcgcgcttcagtatatgacatgctataccggactgttcggcggcatttccggcgatcttgcagactatttctggaagcgccagtgcttttttaccgtggcgggactcgccgttctcgccgcagtctatatcgtcgattacacgatacttggccggtatcccctccttctgtggtttggttacttcgtcgtcatatttatcattgcaaatacacacgtcgtaatcatgggaaaagtgagaatctataattatctgacactgttcctgcctctctacgcgggagtgctttatagattccggacaaagggatacggagcggtagctgtctgttatctcttaagcttcatgccatttttcatgggactgaagacgataatggtacatgggagtctggagctcgccggcggctgtttcctgcttctgcttattgccgtatggaaaggattcttccatgtcaaaaaggcccggaccatagcagctcttattgccgtacctgtgctcaccctcctccttctttactggaagggaacggacctgggagtattgcatacgtaccagatgatcaggtttcagtccattttcggcccggatatgcttcattacaactccaatggagggattattccctatcttcaggagtctgtctccagttttcaaatgtttggctcatcggcagcacctgtgccgaaggcaatgaagtttttaaactgtgactacgttgttttctttgtttttgccaaatacggtattgcggccggaaccgccatgctgtgcatacttgccgccacggcgatgaaagcattttccatatcgtggagacagaagaaccgccttggatttctcgtcggaacggcgtgctccgtggttctgacaattcagatgattgtctatgtggcggccaacttcggcgtaccgctggtagagcccatgacgattccgtttctgtcatacggagggcagagtaccctggtgaattacatattgctaggtctgattctcagtgtctacagaaacaaggatattgtttccgaaagacatggaacccggggaaaatggaaaatacggctggaacggctggaatcgtaagtggaaaaaagtgacatgttatgatacactaaggcgtatagaacctgaacggcgatacagaaaacgaaacgttcagacaggaggacgctatgggtgataatatatggcagaacgtatttcaggagatatttaaaaagaacttggagcttatgaaacaggaaccggaagctgcggggctcaatgctttgtttgaccgtgcgggagcgtatgaacagctgacgatcggagaggtgcggctaaagaccggcaggatcgagattggagatccgctctgctacataaatacgaaatattcctgtacgctggaggagacggtggagccggggagctatccggtatcgctgtcagtgatcgatcatccggtctttggattccgcttcctggcggcgaaactggacgtgaacggaaagacgccggtccgctatgaactggccatgcctcagggctatacgattgaagataaagataaaccgggagtatttgccatgttcggtgtggatacgggtctggcctgtatctgtgacagggctgtgtctgtcgtttatgatgattttataaaagagtggcgcggggagaatccggacaaaaatctctatgacgactgctttgcggaggccatgaaggcttatgcaaaacagtatccccgatatcagagggaggacggcgattatatggactggtgtccgccgggaagcgatgaaaatctgattctctttaccagtggtttcggtgacggtgcgtacagcggttactggggggttgacgaaaatggggacaaggcgtgtcttgtgatccgttttatcgatccggaggcctacgacgttcctatgccggagcttccgcggcgtaagaagttcttcatgaaggcggaagagataaagccgctgctggagagcggccagtttggtatcgccaccgataagattatggtggaaggctccaaagtgggctatatggtgcgtaatgagccgcaggaggaacacccggaggacagcggatggatcttctatgagggatcggaagaccgggaatactgcgaggacagcgggcatttcggactctatgatctgaatacggtggcaaactatgatcccgatatcattccgcttcttgacgcccctgcgggcatggcatttttccgcggtgaagatgggaaattctatgtggatgcgggtgcgaacggagggaattgagaatagaaaaatgaccagaacttttcggcacctgactcacaggggttgacaaatgctgaaaaaacctctatgatatcaccataaagaaaaaaggtaatgaagaagaggagtacgttcataaccctgatagagaaaaccattcaccggctgaaagatggttaaggaagtgtgtgcggaaggtagctttggaaccggagtgctgaaatacagtggtgttcagtaggcgctcacgcgtggtttgcgttaaagaccgtgagagctgtggcgcagactgccgcaggaaaaaaggtggtaccgcggattattcgccctttgcatggaatacatgcagagggcttttttttatttcacaggaaagttcgttctatgaataaaaaccctccgggaggatgcgcactccgcgctaagaaagtatggccgctgaagcgaccgcgctccggcgcgagagtccggctcggaagtgctgctttttggtagtattgtgtttttatgacagacaagtaaatggaaaggagaatcgccgtggaacctttgtttatcaatacataccagatgacacccgagctgctgcgggagtatacgaactgtatgacagccccgaggcgaaaggttctgcttgtattcggaatcctgtgtttcatctggggaatcctgtttacctctcatgcagcgctgagagttctgctgcctgttctgggagtaacagcgatcctttgcagcgtgttttacagtgcctggcttgcgaagaagaattacaggagatatgaaatgagccatgccgggctggataaagcaatatccttttatccggacagaatggaatgtgtgaatgacggcggggagtcaaagaccttttactatagacatataaccagagagaaggagtctggcagtctgtattccattgtcgtaaaaaatgaaaccggtattatcgtaaagaaggattcctttcaaaaagggaccttcgaagagttccgggagtttatgaagcagggaaggcatagctttccggaaagatatgaggcctcgggcagaaacgacgccccatcatttgaaaattcatatcaggtcacgccggaactgcttcaggaatacacgaaatgcatgacagcttcgaggcgaaccgtccatatcgtacttggagtcgtgtatctggcctgggggctgttattcccggtccatatcgtgcttaagcttctgctgattgtcctgggagtgctgttccttttcctcagtgtgttttacagctccaggctggcaaaaaggaactacagagtctatgaagtgagccataccggaatgggaaagaccatattgttttatccggacagaattgagtgtgcaaatgacggtgaagcggcgaaaacatattattacagccagatttccagggtgaaagagtcaagcggcctgtacgtcattgtcatagaaaaaaccataggcattatggtaaagaaagatgcttttcaaaaaggagatttcgaagagtttcaaaacttcatgaaacagggcagacagccttagaaaaatcagaaagaaaacagataaggagaataccatgaaagaactagaaaaaaattataatcctgccgaaattgagggcaagatataccagaaatggctggacaggaagtatttccacgcagagccaaatccggacaaaaaaccgtttaccattgtgatgcctccgccaaatatcaccggccagcttcatatgggccacgcgctggacaacaccatgcaggacattttaatccgctacaaacggatgcagggatacgaggcgctctggcagccaggtacggatcacgcggcgatcgccacagaggtcaaggtaatcgagagcttaaagaagcagggcatcgataaggaggacctgggccgtgacggattcctggagaaatgctgggactggagaaaggaatacggcggacgcattatcaaccagctgcataagatgggctcctccgcagactgggacagagaacgttttaccatggacgagggctgttcggaagcggtgcaggaagtatttatccgtctgtatgagaaaggctatatttacaaggggtccagaatcatcaactggtgcccggtatgccagacctccatatcggacgcagaggtagagcatgtggaccaggacggatttttctggcatatcaactatccggtagcgggagaggaaggttcctttgtggagatcgcaaccacgagaccggagacgctactcggcgatacggctgtggcagtcaatccggaggatgagcgctacaccaatctcgttggaaagatgctggagctgcctctcacgggacgcactatcccggtgattgccgactcctacgtagacaaagaattcggtaccggatgtgtaaagatcacaccggcccatgaccctaacgacttcgaggtgggcaaacgccacaaccttccggagcttacgattatgaacgacgacgcgaccatcagtctgcctggcagcaggtacgatgggatggagcgctacgaggccagaaaagccatcgtagaggatttgaaggagctgggccttctcgtaaaggtggttccccatacccacgccgtaggtactcatgaccgctgtaagaccacggtagagccgatggtgaagcagcagtggtttgtacgcatggaagagatggcaaagccggcgatcgaggcgttgaagagcggaaaactgaaatttgtgccggagcgttttgataagacgtatctgcactggctggagagcatccgcgactggtgtatttccagacagctgtggtggggccacaggattccggcctattactgcgacgaatgcggagagattgttgtaagcaaggaaagaccggagaagtgcccgaaatgcggatgcactcaccttactcaggatgaagacacgctcgatacctggttttcttctgctctgtggccgttctccacgctcggatggccgaacgagacagaggacttgaagtatttctacccgacagacgtgctggtgaccggttacgatattattttcttctgggtgatccgtatggtgttctcgggaattgaacatactggaaaactgccgttccataccgtgctgatgcacggcctggtcagagattccgaaggccgcaagatgagcaagtccttaggcaacggcatcgatccgctggaagtcatcgacaagtacggcgcggacgccctgcgtatgacactcattaccggcaatgcccctggaaacgatatgcgtttctactgggagagagtggaagccagccggaacttcgccaacaaggtatggaacgcttcccgcttcatgatgatgaacatcgagaaggcgccggacagccaggcggagctgtctgatctgaccatggcggataaatggatcctctccaaggccaacaccctggcccgcgatgtgacagacaatttagacaagtatgaactgggaatcgccctccagaaggtttacgattttatctgggaggagttctgcgactggtatatcgagatggtaaagccgagactctggaacgaagaggataccacaaaggcagcggccatctggaccttaaagaccgtgctgatcaattccctgaagctgcttcatccgtatatgccgttcctcaccgaggaaatcttctgcaatcttcaggacgaggaagagtccatcatggtatccgcatggccggaatataaggaggaatggaactttgccgaggaagagcatgcggtagagaccatcaaggaagcggtaagaggcatccggaatgtccggacttccatgaacgttccgccgaacaagaaggcaaaggtatacgttgtatcagagaacagcgaaatcctggatatcttcgagcacagccgcgtattcttcgccatgctgggctatgccagcgaaatcgtgctaaagaaggataaggaaggaatcggcgaagatgccgtgtccgctgtgatccatcaggcagtcatctatatgccgtttgccgagctggttgacatcgagaaggaaaaggaacggttaaagaaggaagaggaacggttatccagagagctgtcccgcgtaaagggaatgctgagcaacgagaaattcgtaagcaaggcgccggcagccaaactggaggaagaaaaggcgaaactggaaaaatatacacagatgatggatcaggtgaaggagcgtatcgctcagttaggcgaataagagcgcgcagcctgtcctgtttaccaatctttataagaaaagagtcgaacccggcggaaaaaatctgcctggttcgactctttttttcgtgtgagatacggaaactctctctccctcgtgtttggcggtatgcggcgaggtctatcaagcggcaaagctttgtgattggtttgtgaaacgcatggacggtccggtgcaaacagatgtttgaccataaaatgtcgaatcatgatgaaaataccgggaaaaaggcgatgaaaaacaggaatcagggccgccgttttgacaaaatctgaaggtctctctgactataatgttcatacagggcaggaggtgagaaaacttttagtgacggttgacttatacatagatgtgttttttgtcataaacatgatcctggattatcttgtgctttccataaccggaaaggtgatgagataccgggcgggcagatacagaatcgtgctgggcgctgctttgggagctgcctgggccgtcctgtgcgcggcatttccgtccattccccccgcagtctctttttttatgacctacgccgtggtcagctgcctgatggtggtgacggcgttcggcgtcagaaagaagcgggagattggcaaggctgtagcctgcctctatctggtgaccgtcatgatggccggagccatgcaggctctctaccagcatacgatggccggttattatatagaacagatccttcgcggaaataaccgggcggccatgccgttttaccggctgctgctgctggctgccggcgcttacttcggcgtgaggtgtatcctgggcttcgttttggaggccagaaagagccggaaccatttctacgaggtaacgatgcattacagagggcggaagaagacggtgacagcgcttctcgataccggtaaccggctgtatgagccagtgacgcaccggccggttcatgtggtgacctacgaggcgcttaaggaactgtgcgagagcgtgtcctctgtcatatacattccgtttgggagtgtgggaaagaaggaaggcgtgatgcccgggattttcctggatgaaatggaaatacgccagggcagtgacgtgaaaattatagaaaagcctctggtggctgtctgccgccgtcccctgtctgtggacggggaataccagatgcttctgcatgaagattagtttcagatgaaaaggagagattaccgatatgatattaaaagtttccgtaccaaaccgtttccagtttaaagccgtacccacgtttaagacgctgatgatgccgaagcagggagagattcattacattggcggcgccgatattcttccggccccactggataatgagtccgaggcgagagtgattgccatgctgggaggcgaagacgaccagagcgcaaagtcggagctgatcgagcataatctccgccttgtcgtctacatagccaagaaatttgacaataccagtgtcggcgtagaggacttaatctccatcggaaccatcggtctgatcaaggcgatcaacacctttaaccctgagaagaacatcaaactggccacctacgcgtcacgctgtattgagaacgagattctcatgtatctgcggcgcaacaataagacgaagatggaggtatccatcgatgagccgttaaatgtggactgggatggaaatgaacttttgctgtccgatattctgggaacagacgaggacgtgatctacaaggatttggagacagaagtggaacgcaatctcttaaattccgccatcagccggctgagcccgagggagagaaagatcgtggagctccgctttggcctgtccgacgaggagggggaggaaatgacccagaaagaggtggccgatttgctcggaatctcccagtcctatatttcccgtctggaaaagaagattatgaagaggctgaaaaaagaaattgtgcgttttgagtagcggaaggaattaatatttatccgtttttttctttaaaaatgatttgatctatagtataataataaaaagtggcacgtcggaaaggtataaggctttccgggtgccactttttatgtagtaggaaagtactcctattacataaaaagccctccgggccggactccttgttcccttgcccgaataaataagattattttcgcaactttttgataacagcaaacgtctaacagacagaagaggagagaggaggaagaatatttgaagaagaatttagaagctgaagctgagaaaatactcctgaccaattatgaaaagtattatcgtctcgcctacagctatgtgaacaacgaacaggatgcgctggacattgtccaggaaagtgcttataaggtgatgaaagatattagtaaggtgcgggagccggattatttatccacctggatctaccgcgtggtgatgaatacggccgtcgattttctgaggaagagacagaaggagagcatcggtctggagggggtggagatcccccacgaggatgtctatcatgaggatgatccgatggagcttctcaagtcactggaggaaaaagaccgtaccatcgtggtattaaaggttatagaggaactgaagctggaagagatcgctgtggtactggatttgaatgtcaacacggtaaaagcaagactgtaccgggcactgaaaaaactcagaatcgaactgaagtcggaaatgtcatagaaaggggacacattatggaaaacgacagcagaaacaatttggagaagttaaaagaagaatatcataacattccggtgccggcctcggccagggaaaacatgatggcaggaattgaaaaggcaaaaaaagaaaagaggatgagaatcgtgatacagtttacaaagaagacaggattaacagcggcggctgcgctgctcgccatcactgtgatggcaaacgtaagccccacgaccgcaaatgccatggaaaatattccggtgctcggaaccattgccaaggtggtaaccttccgcacctttgaagatacaaaagataattatgaggcgaagatcgatattccccaggtatccatcggagatcaggcgaacacagaggtcaacaagtccatcgaggagtatgcgaaccagctgatcgccgaatacgagaaggaagtgacagaggacgttgccggcgagggccattactctgtaacctccagctaccaggtggtgacagacaatgataagtatctgtctctgcgcatcaacacaaccgtgattatggccagtggtgcagactttgtgaagatcttcacaatagacaaggcaacaggccaggtagtaaccttaaaggacttatttcgggataaagcggattatattcaggctctcagcgataatataaaagagcagatgagggctcagatggcggctgacgattccaagatgtatttctttgaatccggcgaggaggccgcagaggacttcaatcagattaccggtgacgagagcttctatttcaacgagaatggagagctggtgcttgtatttgacgagtataccgtggctccgggatatatgggagttgtggaatttaccatcccgaaatcggtaacgggagatattggctgattggaataatttggaataaagagtccggctgtccggattctcccatgaaatcaaagcagcaggcgtctggacgaaagagtccggatgcctgctgctgtttttggttgcgtcctgtctcatacaatgatataatttttcgaccccactctttcaataaaaaatttacaggagatgaaacttttcacatcctgagtttgtcaataaagtagacgggaacaaatacagcatgcctgtgaaaggagacagaaaacaaaatatgaaacaggatcattatgacattgtggtaaattatatcattgcaaatcagaagaagttttacaggctggcctatacctatgtgagaaacgagaacgacgcgctggatatcgttcagaatgccatctgcagcgcgctggagcattatgagtcgatacgggagatctcgtatattaaaacctggttttacagagtgctggttcatgagagcctgaactatgtcagaaagaagaaccgggaaatcgtgagtgatgaaccgctgggcggggaggccgcctatgtggagccgggctacggggagacggaggggttctttgaagagctggaccgtcttccggccgatacccagaatgtgatcagactgagattttatgaggagatgtctctgcaggaaattgctgcggttatggaactgagtgtaaacactgtaaaatcgaaattgtacagagggcttaaatcattaaaggaggagctggtgatatgagcagattgaaggacagcaagaacgtatacgacaacattccgatcccggaccggttggaggagactgtggcctcagccattgagcgggccgccgcgcagcgaaaagaagaaaatggtgtaccggaccagccggcaatggatcgccgggacaggaaaaaatggagaaggcggggcagagtgatctccggctgtggtctggctgctgcggccgcactgacggtagtggtcgccgtcggggttaataccagcccgacgtttgccgaagaaatacgggggattccggtaattggagctatcgtaaggctgtttaccgcagaatcgtggcagtccgacacggatgatgccggaatctcggtggaggtcccgggaattgagatgattcgcggcgagacgaaaaatctggcggatgagatcaacgaggaaatcaaggcgaagtgcgacgcatacgcggcagcggccgtagaacgggcaaaggagtacaaaaaggcattcctggatacgggcggaacggaagcggagtggaaagagcatgatattcagattcgcgtatggtatgaactgaaaagccagaacgattcccatctctcctttacggtcagcggatctgaaaactgggtctccgcctacagcgagacgtattactacaatatcgacctgacaaacggaaggtatctgagcctggaggaccttttagggccgggttacatggaaaaggcgaatgagagcatacgcgcccagatcaaagtgcgggaagcggactctgaagtgaaattctttacaaaggctgaaggcggctttgaaaccgtgacggcggataccccgttctatatcaatgagaagggcaatccagtcgtagtatttgaaaagtatgagattgcgcccggggcgctcggacgtccggagtttgagatcgaaaggcagacggaggagaaagcgcctgcggagaccacggcaaaggagcgtatgacggaagaacaggcggagtccggcggcctggataatttctccgtggatcagagcgaggcggaggcctttgccggcagaattcagaaggctgtcgcagaacaggatctggaggcgctggctgactgcatctccttccctacctatataggttttccggatgaaggcgtcgtggtcagtacgagagaagaatttctcgctttcggaaaagagaagatctttacggctgatcttatttcctccataaaaaatacggatattacggcgctggaggcgagcatggcagggtttcatatgcaggagcagtcggaggagaggaaaccaggcatcacatttggtatcgtggatggaaaactggctgttaatggaatcaattactgatctgtaaagtgaggaaaggcagcctctctgaaaaggatactggacagtcttcccgaagatgcgcttgacatgagaggtctatcgtgatagacttaacacgaaggactactgcgatagaccagaaccatgcggcaatgatggattggagggaggcatttacatggaagaaaagaaggagattcttgaaaagaatcagatagaagaaaagaatcaaatagaagaaaagaaactgtatgagagcgaataccgtttcatgaacctgatctgggacaatgagccggtgaattccacggagcttgtgagaatctgcggaaaagagctgggatggaagaagtccacctgttatacggtcttaaaaaaactggcaggaaggggcttcgtgaagaatgaacaggccatcgtgagctctctgattcccagggaagaggttttgaagtacgagagtgagacggtagtggacagaaactttgacggttctctgcccgcctttgtgactgcttttctgaaggacagaaagctgacagcgaaggaagcggaggaaatcagacagatgatagaaaaggcggtgaagtaatggatgtggatcagatgatgatcactcttttgaacatgagcattaccgcaggctttgccgcccttttggtgatggcgctgcgcctgctgtataagaggcttcccaagcggttttcctgtgtgctgtggctggtagtgatctttcgctttttatgcccgttttccctccagtcggcttacagcctgctgccattttattcgaatcccctggaggagcggatcatctatgaaaacacgccctccattgattcgggggtcttctttatagaccgtcccgtaaaccaggttctggagcagaccatgaccgtgaccaatccctatatgtcggtcaatcccatacagatcctgctgtttgtgatgctggtagtctgggaggcggggatgctggtcttcttcctcttccattttgccgggtatatccgtttgaaatggaggcttggaacggcagtgaagatccaggagcccgatccggaccatgaggatgaaaaaggccggagaccggaacacgggatttatgaatctgaccggattcccggcgcctttgtcatgggaatattccgcccggtgatctaccttccttcaaacttaacggagatggaacgggagtgtgtcttgaggcatgaacggatccatatccggcgtcgtgactatctcgttaagcttctggggcttctgatggttatcgtgcactggtttaaccccatcgcccatatagctttccgtctgctctgcaaggacatggagatgtcctgtgacgaggcggtggtgagcgagctgggacagggcggaaagaggcagtactcgctggcactcctgtctgctgcggagaaaggcagcggagcgcgcctgcccctggcctttggagagagccatacgaaatcgagaataaagaatgttttaaactataagaaagcgggcttcaggatcacgctctgcgccgtgatcgtaacggcagcggccgtgctgtgcctcatgaccgtcagggaaaaacccgtggatccggaggcggtttccatcattggaggcggagacggtcctaccagcattttcattgcaggtaaggatgacggcgagacgccggctatgcctgtggaaatgccggatacctcctggctctccggacaggtattggaaaaggggcttgaaagtaccattaccatagattatgcctcaaaggatcagatcatttttcatggaagctgcggcctgttcagttttcagcttaaagatggtaaatgggtgccgaatttaatcattgggccggatgatacgggaaccatcgacttggaggcgataaccagcgcgcttgatgcggtgaaaaaggaaccggaatcggaagacagcgttcacagagaagattctttcgtcggtaagaatccgacagccggaagttcttttatcgattacgatgtggaaaagcttgccgacggaagcatcgccgtacttggaggtatgggtacctcctcgagcaatggaggattgacgggaaagctggtggatgtattttacggttggtaccatccggacgatatggtgatgcatcaggcatacttattcgccggagacggtacaatggtggaaaataacagcggagagatcgaggagcggcggtacttgtttacgactgacggcgctgattacttcctcagaactccgcagacagctcttgaatttgaactgcaggatggaaaagagccggaaagccttcattttccatatgaccggctggagctggtgagaaatgcagggggatctgtccaggttctggatcccatggtgatcatgggacagccggaaagccagaagatggttctggcggaaggaaggatctactattacggtgcggcgaaggcggatatactgagctttaaatctcattccctgatcggaatccgcacggatggcagcgaccgccgggtagccgggatcgactactcggtttgcaggggtctgtcctacgacaacggctatctctattatgaaggctggaaaaatgccatggagttcccgcgcccgatttaccgcatgaagcctgatttcagtgagataacaaagctgggagattttaacggaaacctgatatccgtggtggatggaaccttctatctgttaagcgcggaaaaaccagccatcgtgctgacgcgggaaggccgctttgacgaggttatgtattacgataagtgcggatacgacgcgaagaactatgagtgcgtggcggcgtccgcggccgacgggaagcttgcgatgaagttcgtgaatctgtcggagaaccgggagtatgtgaattatgagattccgctggcggcgggggatttgtggaagaaggtaaataaaaagtgattaccggtgtgctgggtatacttgtgtgttgggtataattcattacagtaatagaaaaagatgcagttgccaggtaaatgtaatgatatttataattgagcaatcgtgtttaaaatgtatatagtgtgtttttttcgaaggcaggatcataaatactgatcctgtcttcactttttatcttaatagtttaaggaaaaagactataaaagtatagtcgatatatgggggagaatatgtaataaatatagataataccggagcgatggaattgaattgacaatatgatgtcaaagagatatacttaaatgactaagcgtatatagtcatctgtgctccgcaacacaagtgaaaattagaggcaatccaattatatttgacatttttaatagttgagtaataaaaggtgagaggtgcataggtacatgattggtatgtcgtgtatcttaagcataactatattatagggaaagcgttgagtccgatgattatttcatttttatccgatgcatttaactaatacgtttataaatacgaaaagagaggtactttatgaaattactgaaaaaaataattgcaatgataactggagtcagcctgttagccgtaactatgaattttccgttttttgctcagggaaacacaacttctgcgcaaagtgatttcgaatccctgcttaacgagtatcatatcacggtgcgaggagcgagtgccgagataagtgcgaaagaacttaagggaataatgaaaacagggagtccctccgcgcgtatacaaaaaattaatatgaatacagatgcgccagtcagattatctgcaaaagagttactggaactgcagtattataatacagaaggcgaaatgagagagagttttctttcagaagcacgcaattccgtaattgatgtagaactggtacggggaaagacaacttggggaattggaagttctttcactccgtatgaagatcctgatgcggctgcgccgagaaaaacaacaaatatttcatataaaaagacagataacctaaaatatataaaaacacaggatcttgttggggaatgcaagatcctgtgtttttatatatagagcaaaagttagatgtaatcaatgtggacaaacttcatgtgtttcggtatcaattaatgatcccagtattatcttgccacacttggaacagcgctgggcgtcataatatttggtgatacagccgccattgcttttctttgagtgtttggatatcgttccttcaacataatcatgattgcaggcagcatactcggaacggtcggaagtatcaattttatatatgtttccgtcggtatcggtgaactggtaatcatataaaatgggactggaactatttgtgagcttaaaatctccactttgaaaaacgatagtgtcagaggaacgaatgtttaatagaggattattcgaactattgcaaaccatatccagttccgttggggattggtaagcaaaagcagtaaaactgctgcacaaaaccatacaggaagctagtaatacagataatctttttccgtgtttcttttgtttatcaggaatcataattaaatccatcctttctttgagaccgttggacgagttactgaatgaagatgcataggtggttcgatactgcacgtcattagctgccatatctatgattagcgaggcataatttttccgatccttttgattcattcctagtgtgactatttcatcacaggaggcctcgaccgttttatttaattgaagttcaagaagatagaccaacgggttaaaccagtagatgcaagtgacaagatgtcgtagaaataaaaataatgtatcacaacgacgaatgtgagtcagctcgtgttttaaaataagtctttgtttttcagatgacaggttagcaggcaacacgataagaggtgaaagtatccccgctgtaaatgggcttatacaatttgattgatataggcggatttttcttttgattctcacagtttgacgataatgatcgacataatctataatatctagatcagtgatttccgtcatagacaactgaatcagttttttaaatcgaaaatattttaactgttgccagacaaatgcggcaatggccatgacaatccaaataagcacaatcgtgagatttatctgataagcagagtttgtataggtactgtgaggagtggataccataattggaatatttccggcaagtttaaaatcggtctgagttggtgcttggtgcagaatcagttttagaaatcctaacggagtcagaaaaaagaatagcacgagcttcaatatgatatatttccagcgattgctcaaactatttttaaaaattctgacagcaattaagtataataaaaataaaatacttccggtgaagcacattgtaaaaataatattcaatgtattgtgtccctccttaaaacttataattgatccagatattcctttaattctttaatatcttcggattttaaagagtgactatcggataaggccgctacaaatttttttaaagatccaccgtaaagagcgttaagaacttcagaagccttttgtgcttcatattcttctttcgtatacgcataaatatattttcgcccgttttttactacgagacctttttcaatcagccgggttaaataagtattcaccgtctgacgtttccattctttgcctaagtgctcaaaatattcaattaattcattgatagttatccagtgtttactttcccataagacgttcataatggcctgctcagcaggtgtaatatcttgcttcattcaactcactcccaatggtatgatatatacgactaataacattagtcgtatatatcataccatttacacaagttcttgtcaataaaagagctggattgagtggaaagttataatacaacagcatccgatggcaattttgaaaaaatgatcagcatcttagatatgactatacatagtagtctcattagaaatgcgttttaaaagctaaaggctggcaacctttgaagaaaaaatatttctatagaataaataaaagtaggaaggaaattcaaaattattgaatttccttcctatttataagctcataacggaaatgcagttcgatgcttctatctgattacgtatttctctctatttttacgaaaggtatcccttcatgcttttgagtgcgtttttttccagacggctgacctgggcctggctgatgtgaatttcctcggctacctcagtctgggtctttccctcgaagaagcgcatgtcgataatgtggcgttcccgttcgggaaggcgtttcatggcttcatttaaggagatgtcctccacccagttttcctccagattctttttgtcgctgatctggtccatgacgaagagtggatcgccgccgtcggaatatacaggctcgtacaggctgacagggctctgaatggcatccagagcataggtgatgtcctccttgctgacgccgatttcattggcgatttccatgatggtaggctcttttaagtttttcttcatgagattttcttttgcatagatggctttataggcggtgtcgcgtaaggaacggctgacacggatcgaattgttatcccgaagatagcggcgtacctcgccgagtatcatgggaacggcatacgttgaaaagcgtacgttctgtgtaatgtcaaaattgtcaatggctttgatcaggccgatgcagccaatctggaacaagtcgtccacattttcgttactgcctgaaaaacgctgtatgacgctgagaaccagtcttaagttacccttaatatattcctctctggcttccatatcgccatccaggatcctcttaaataaggcttctttttcttcgttgtttaaaaggggcagctttgaagtgttaacgccgcagatctctactttgtatacaggcatgtctttccctccgcatcattctttttagtcataaaggaatgatgtacttattcggaggcttttatacgatgccagatttaaattttatttccattttctggcggcggtccgcaaagtgcctgtttatcgcattggctcatacatcaggtgcgcagatgagccagtgaatgtttgcggtccgccgcgtgagctgcggattttatttgtttttttcgtaaagaatgaggagaccttttaataaaagcgcctcatcgtaattgattttatgacggcagagcgggaggacggaaggggccagaccgcccgtggctacgaggcttgcggcctgtcccagctcttcttccatgcggtcgatgatgccgtcaatcatggcggcattgccatagagaataccgtttttcatgcagtcgatggtgttcttgccgatgacccgggtcggtctgtttaaaccgatgtagggaagctgggccgcgcggctgctcaaagaatccagagaaacccggagccccgggaaaatgatgccgcctgtatagttgcccgccctgtcaatgacggacatggtggtggcggttcccatgtcgatgataataatgggagacgggtaatccttaagcgcggccacggcgtcaacaattaagtcgctccccacggtcttcggattatccatgatgatattaagtcccgttttcatgccggagccaaccagcatgggcgtctttccggtgattttcttaactgcagagagcaccacgtccgtcagcggcggaacgacggaagagaccacggccccttcaatcgaggaaagcggcaggttatggattgccataatgtctttgatattaactgcgtattccaggtctgtcttccccaggttcgtggtgacacgctccacaaaccaggtgcggctgtcatcaataccgccgattacaatattgctgtttcccatgtcaattgctaaaatcataaagggaactcctttccaaaatttagaggttatggtatactatgagcacttagtgaggtttttcacgagtttaccacattttaggcaaaataacaatgtaagcagaaataaaaagaagcgaggcaggagacgtttatgctgaaaggaaaacatgttgttctgggaattacgggaagtatcgcggcatacaagacggccggactggccagcatgctggtgaaaaagggctgccatgtccatgtactgatgacagagaatgcgactaattttatcaatccgatcacgtttgagacactgacaggaaataaatgccttgtagatacctttgaccggaattttgaattcagcgtggagcatgtggcgctcgccaagcaggcggacgtggtgatgattgccccggcttccgccaactccatcgcaaagctggctcacgggctggccgatgatatgctgacgacgaccgtgctggcctgccgctgcaggaagatcattgcaccggccatgaacacgaatatgtatgaaaacccgattgttcaggataatataaagatttgtgaaaagtatgggttggaagtgataaaaccggcggtgggctacttggcctgcggcgatacgggggcgggaaagatgccggagccggccgagctgttcgactacattgaacaggagatcggggcgcagaaggatctggagggaaagaagattctcgtcacagcgggcccaacgagagaggcgattgatccggtccgctatatcaccaaccattctaccggcaagatgggctatgccgtcgctaaggccgcggctctgcgaggggctgatgtgacgctggtgaccggaaagacagacacgcccaaaccgcgtttcgtaaagctgatcgagatccaaagcgccgcagacatgttcgaggcggtgacggcagcggcggcggaacaggatattatcattaaggcggcggccgtggcggattaccggcctaaatcagtgggcacggaaaagacgaagaagacggacggagatatggcgatcgagctggagcggaccgatgacattttaaaatggctgggcgcgcaccggagggaaggccagtttctctgcggattttccatggaaacccagaatatgctggagaattccagggtgaagctggataaaaagaatattgacatgattgtggcaaataatctgaaggtggaaggcgccggcttcggcaccgatacgaacgtcgtgaccatcatcacgagagagcggaatctggagctggagaagatgacgaaggaagaggtcgccgaccggctgctggatgagatacttgccgtatcagcagataaataaaatggaatgacaaaggggaaaatcatcatgaatacagagaaaaaagaaattatagttccggggcagctgacaggaccggcgctgctcaccggatatctgataaaagaagtgagtgtggcgccggacagacagcggccggctgtgatcgtctgtgccggaggcggatactggcagagatcggatcgggagagtgagcccctggcgcttcagtttatggccatgggatgccatgcctttattctcgactacagcgttgccccgaaccatttcccaacctctgtgagagagcttggggaagcggttgcctatatcagggaacacgcggcagagtggaaggtcgatccggcaaagatcatcgtgtgcggttcttccgctgcgggccatttggcctgcagtctcggcgtattctgggacaatgagctggtatatgatgcgatcggcagaacacccgcacagattcgcccggatggcctgatcctgtgttatccggtcattacaggcggcgagtacgcgcacgtgaattcctttaagcgtctgcttggggacgatgtgacccaggaacagagagacgcggtttccctggagaattttgtgacggaacagacgccgagggcatttatctggcatacgtatacggacgaaaacgttcctgtggaaaacagcctgcttctggcagccgccatgaaacggaagaatgtcaactttgaacttcatatctatcccaccggcggccacggactttctctggccgacgaggagacggccgggaacggcttccaggtggtggaacagtgccagagctggattcctctcgtgaaaatgtggctgaagcatttcgaagcgtcctgttaaagaggaatgtccgcttcaccacatgaatcttgactttgtaatggaataataatacaataaaaaagattgacacgtaaaattggaggaaacattttgtcgaatataactgaagaaataaagaagagaagaacctttgccatcatttcccaccccgatgccggtaagacgacattgacggagaagtttctgctttacggaggcgccattaatctggctggctctgttaagggaagaaaggcggcaaagcatgcggtctcagactggatggagatcgagaaggagagaggtatttccgttacctcctcggtaatgcagttcaattacgacggatactgcattaatatcctggataccccggggcatcaggatttctcggaggacacataccggacccttatggcggcggattccgcggtcatggtcatagacggttccaagggtgttgaggcgcagacgatcaagctgttcaaggtctgtgtcatgcgccacatccccatatttacctttatcaacaagatggaccgggaagccagggatccgtttgaactgatggacgagatcgagacggtgcttggaatccgtacctgtccggtcaactggccgatcggctgcggccatgagttcaagggtgtctacgacagaaacaagaagacgattaccaccttccaggccgccatgggcggacagaagacggttgatgccaccgaggtacttttaggcgatccccaggtggactggctgatcggcgaggattaccaccaccagctgatggaagacatcgaactgctggatggagccagtgacgaactggatatggatcgtgtcgggaaagggaacttgtcaccggtatttttcggatcggcgctgacgaatttcggcgtggagacatttttacagcatttccttcagatgacgacaacgccgctgccgagactggcggataagggtgtgatcgatccgtttgaagagaaattttcggcctttgtgtttaagatccaggcgaacatgaataaggcccaccgcgacagaatcgcatttatgcgaatcgtatccggaaagtttgaagccggcatggaggtaaaccacgtgcagggcggcaggaaactccggctgtcccaaccgcagcagatgatggctcaggacagaaagatcgtggaggaagcgtacgcaggcgatattatcggcgttttcgatccgggtattttcgccatcggagacacgctgtgcctgtccaatgagaagtttgaatacgagggaatccccacgtttgcgccggagcattttgccagagtgcgccagatggacaccatgaagcggaagcagtttataaagggcgtgaatcagatcgcccaggaaggcgccatccagattttccaggagttcaatacgggcatggaggagatcatcgtcggagtagtcggcgaactgcagttcgaggttctcacctaccgtctggaaaatgagtacaacgtggaagtcaagctggagaagctcccgtatgaatacatccgctgggtagagaataaggatgagattgatgtggcgaagattcagggaacctccgacatgaagcgcatcaaggatttgaaggataatccgcttctgctgtttgtcaacagctggagtgtgggcatggttctggaccgcaatccgggcctgaagctcagtgagttcggtaaaaattaacgggtaaatcaataaggaggcagcagatatgagtaagattgatgtagtcagggcagcgatggtagaagccatgaaggcgaaagacaagcagaggaaagatgcattatccatgcttctttctgcactgaagaatttcgaaatcgataaaaaggatcacgagccgattaccgaggacgaggcgaatacggttgtgaagaaagagatcaagcagtcccaggagacctttgatacagcgcctgcggaccgggatgacatccgcgaggaggcggcttaccgcctgtcagtttataaggaatttgcgcccgaggatatgagcgaggagcagatccgtgaggtagtgacagccgtattggctgagctggagatcgaaaagccggcgccgtcagacaagggaaagattatgaaagtcctgatgccgaaggtaaaaggcaaggcggacggcaaggctgttaatgagattctggcttccatgatgaaataacacgcggctttaccgccgcaggaaaggataagacatgtacagaaaagagattgaagagtttatcgaggcacacagacaggagatgcttgatgacatctgtactctgtgccgcattaacagtgagaaaatgccgtataaagaaggcatgccatacggtcagggagcatttaccgcactggctgaggcactttccatggctgaggcctatggtttctccatcaccaattacgataattacgtgggaaccgcagacctgaatgataaagagagccagctggatattctggcccatctcgatgtcgtcccggcaggagaaggctggaaggaaacagaaccgtttgagccggtggtaaagggcgataagctctttggacgcggcaccgcggatgacaagggaccggcagttgcagcgctctacgccatgagagccgtgaaagagctgggagttcctcttaagaagaatgcacgcctgattctgggaaccgacgaggagtgcggaagctctgacattgcgcattactatgcgattgaaaaagaggctccgatgaccttttcaccggacggctcctacccggtggtcaacacggaaaaaggctcattaaacggtcacttcaccgcttccttcgctccgtctgaggcactgccgaagctggtttccgtggaagccggcatcaaggtcaatgtagtgccgggaaaagcccgcgctgtggttcagggaatcgatgtggaggtaatggagaaggccgctgaggcagtgaccggagaaaccggaatccgttttgaattcgaagtggaggaagattttgcgacgatcacagccatcggtgaaggcgctcatgcgtccaaaccggaagagggcaacaacgcgctgacaggtcttcttgtcctgattcagagactgccgtttgcggcctgcgagcagatcagtaccattggacgccttctggaactgattcctcacggcgacacctccggtaatgctctgggaatcgccatgagcgatgagatctccggagatttaacgctggcattcagcctgctcaccatctctgacagcgagctggatggtaccttcgacagccgatgcccgatctgcgccacaaaagagaatgtactggatgcagcaaaggcaaagatggcggaaaaaggatttacccttctgaatgactccatgaggccgcctcatcacgtggatggagattccgaattcatcagcacgcttcttcgcacctacgaggagtacacaggccgtaagggagagtgtatcgccatcggaggcggtacctacgttcacgagctgaagaacggagtcgcttttggcgccgccatgccggagacggataaccgcatgcacggagccgatgagttcgcagtcatcgaggaactgatcgtcagcgcaaagatgtttgcacaggtaattatcgatctctgttcctaaaatccgtctgtcagacgaattaatacttgacaaatggtatgatgtagcgtaaaatacgcctcataagttaaaatcctagtcgaactataggaataggcgaagggagaaaccgctatgaaccagtttaaagccatgcagatgaatatgtacatgatgaacggcatgatgatgtgccgtatgtcaatgtgcgtaaaaaatcgaaaatgatattcatttgtatggattgtgattgaagtttatggcaaacagggagattgaatcttgaatcgctgtggtcgcaagtctgtgcagggcttgcggcctttttgtgtaatagggaagttgctcctttatcgggtatgcgcactccgcgctgaggaagcctggccgctgaagcgactgtgcttcggcgtgcgagccggcctgccggattcgggcatatccgttaaacagtatggaaaagaaaggaaacgaaagacatgcagtcatcagaaccaattattcagctggtggggctgggcaaagagtttaggacgtcgggcggcccgatcaaggcgctggacgacatcaacctaacgatctgccagggagaagtttttggaattatcggtctttccggtgcgggaaagagtacgctggtacgatgcatcaattatctggaggtaccgacttccggagaggtcctgtttgagaacaggagcctggcgtccatgtccagacgggatcagagaaaggcgagacagtccatgggcatgatcttccagcagtttaacctgctggcacagagaaatgtcattcagaatgtctgcttcccgctggagatcgcaggcgcaccgaagaaagaagcgagagagcgggccatggagctgttagggcttgtagggcttgcggaccgcaaggacgcgtatccgtctcagctttcggggggacagaagcagagggtggcgatcgccagggcactggccaccaatccgaagatcctcttatgtgatgaggccaccagcgcgctggaccccaacaccacgaagtcgatcctggccctgttaaaagagatcaacaaaaccatgggcgttacggtagtcgtgatcacccatgagatgaccgtcatcgaagcgatctgtgaccgcgtggccatcattgaccagagccacatcgcagaagtgggaagcgtatcggagatattctccgagccgaagtcgaagatcgggcggcagctgatcttaggagacgcggccgagcaggcggcgagatttggaaagtccagacgggtgagaatctccttcgacggacgttcctccttcgaaccggtgttatccaatatgatcctggcctgcaaggtgccggtgaatattatccacgcggagacgcgcgacataaacggaacggccatgggacagatggtgatccagcttcccgaggatgaggtcgatgctaaccgggtggccaattacttaaaaacagccaaagtaccatttgaggaggtgacggattatgacatttgatgccgctacattcgatatgctaaaaacaggaatttgggagacactgttcatgacctttacttcttccttctttgcctatttaatcgggattccgctgggaattatcctgattgtgacggataaggacggaatccggccggttccatggcttcagaagattcttggcctggccatcaacctgcttcgttcggtgccgtttatcatccttctgatcatggtgattccgcttacgaaaaagatcgtcggaacgacgctgggcgccaaggcggtgatcccgccgctggtaatcgcggccgcgccctatgtggcgagagtcgtggagtcgtccttcaaggaagtggatgcgggagtcatcgaggcagccaagtccatgggagcctccaccatgcagatagtatggaaggtgctccttccggaagcgaagccttccctgcttgtgggagccgcgctgtcggtgaccaccatcctgtcctattcggccatgtccggctttgtcggaggcggcggtctgggcgatattgccatcaaatacggctattaccgctatcagacagagatgatgttcgtaaccgtggcgattctcgttatcattgtccagatcatacaggaggcgggcatgaagctgtcccgcgtcagcgataagcgaatccgctagatcatagatcataaagaagtaatggccgtaaggcgttaccataaaaacgatcactcgcacgctatgcgcacgagtcaccgtaacaatcaagaggcgcaggaaactgcacaacaaaaaggaggaaacaattatgaaaaaatcactttacgtactggctgccgcgctgcttgcagcgggagcactgaccgcctgcggcggaaacagcaaggagacgaatgccgagacgacaacagcggctgttacagagtccaaggagaccgaaagcgctgcaccggccgatgagacaacggcagcagccggagaattaaagaagctggtggtgggggcttctccggcacctcacgcagagatcttaaaggcagccaaggacattttaaaggaaaagggttacgatctggtaatcaaggagtacaccgactacgtacagccgaatctggcgctggaatccggtgatctggatgccaactacttccagcacttcccatacttagagcagttcaaccaggaaaacggcacggatctcgtatccgcaggtgcaatccactatgaaccgttcggaatctatgcaggaaagaccgcttccctggcagatttagcggacggagcgcaggtagcggtaccgaacgacgtatccaatgaggcgagagcacttcttctcctgtccgacaacggcctgatcgagttaaaggaaggcgttggtctggaagcaacaaagaatgacattgtaaagaatgacaagaacttaaagatcatggaaatcgaggcagcacagcttccgcgctccctgggtgatgtggacattgccgttatcaacggcaactacgccatcgaggcaggcttaaaggtgacggatgctctggttaccgaggattcccagtcgatcgcagccaccacatacggcaacgtcgtagcggttcgcgcaggcgaggagaaatccgacgcgactctggctctgattgatgcgctgacaagcgataccgtaaagaagtatattgaagacacgtatcagggtgcagtagttccgttattctaagatatgtaaatgggaacagtaccgccggattattggcgggctgttctttttttgcgaaatgcggcggagcagggggctggcgggcggcaatctttgctcagacgtcattgaaaatccatattctctgtggtaaagtataaccatattaaaatagaagagtatgcagccctgcacggctgccggagaaccatatgaggggatggaacgagatacgaagccggatcagtgacagcatccgggagatgaagcatgcggcgccgaaaggttccggaagaagactcagctatatgaagcgttatttcctgaagatgcttctgctgatcatcatactggtgggcgttctggtgttcatgatgaccaggttctccaagagcgtggtgggggatgagatcatcagcctgcaccgttcgatcttaaaccagacgatccggcagccggccgagaccatccggagtcttaaggaaagtctggaaaagattacggaaaacacccgcgtgatcgactggatcgtaggcggtgagggggacacggaagagatcgacgcgtatatccgcgatgagatctacgggaattataagaaaggcaataagttccggatctatatctacgatctggatgagctgcgttatgccagtgactctccggagctgccggtggaggaggccagggaggcgcttaagcaggcggcgcttctggagcagaaaaatccgaaggacaatcgatatctgggcgggccgctgcagagcgggcaggagcaggggctttaccgccacagcttttacctgacccagccaattaaggacctcttaagcggcagtgtacgtggttatgccctgatgcagttcagcgaggtggttctgtacgattcctattcggacatgattgaaaaagacagggattactgcattgtggacgcggaaggcatcgtgctgtccggcaagaataagaaccatatcgggctgccctaccagaaaaatgatatcgtcatcgagaaccgggaggcccttggctccggttatgggatatcgaaagcatttccggataatgtctatttctatgagaatatctcaggaacggagtggttcctgctggagaatgcggatatccaccatctctttgcgccgatcgaccggatgacgttcttctcctttctgctgctggcagtgttcgccgtctgttttctgccggtgacagccgtctccctccgtgtgatattaaagccgatcgacgccataaagaataagatggacatggtggcccgcggagaacttcaggccaggatcgaggaggcggaaaagggaaaaggagagctttccgagatcgctgattccttcaattacatggtcgggaagctggagagccaggtcgatgagatcggcgtgatggagcggaaaaaacatctgctgcagctggactttttacagacgcagatcaacccgcattttatctacaatacgctcagctccatccggttttatgtggagatgggaaaaaatgaggccgccgagaagatgctgatcgatttttccaaaatactgagaaagacgctctccagttccgagaaaatgatcagcctgagagaggagcgggagactctcctctattatattgacctccagaaggcaagataccgggaccgtttcgaggtggagttcgacatgccggaaaatacgctttcctgtattgttccggattttatactgcagcctattgtggaaaatgcaatcttttacagcctacagaagaagcaggtctgccatatcgtaatcaggagctatctcgatcctgacgtacatctgacagaaagcaattttcaaacacgccccaggacgctctgtatcagtgtaaaggacgacggaatcggcatggatgaggataaattaagcactgtcctggataagggcatgaatatgaacaaggttggcctgcgcaatgtgaacgagagattaaagctgaatttcggcgaagaatacgggatccggatcttaagcgaggaaggtgtgggaaccgaggtgatcttaagcatgccggtaaatatgagaggaaagaatttagatgaaaatactgatagcggacgatgaaacacccatcagagaatggatacaattcagcattgaacgcggcaatcatccggattttgagatagtgggagtggcggaaaacggaaacgatgccctggaactggcgctggaacaccatgtggatacagtgatcaccgatatcaaaatgccggggatggatggcctgatgctgatgaagaagcttctggaaaagatgccgtacgtctcgtttatcattctgacaaactatgcggaattttcttatgcccgggaggccattacctatggagccaagaagtattttttaaagtcagagcttcgcggacaggacattctggaagcgctcttagagatcgagagcgagcgggcggcccttctggaagcgaaggaggaggactgctactcaaacggctatctcgatatcttcacctgctgtcaccgcctggacgacggtgcctttatccggtcgttctggcagaaacaccattttatggaggagctggacttcgccgtcgtggcgttgagaagccggagcagtgaaggacagaaagagaagctggacgggtttatcagggatcagaagcttcatattctgcggccggtgctgagaaatgagagtatttacctgatcctgcaggcggaaagcggggaactgttaaaggaagccgttcaggcctttgtgagctactggaatgaacgggagcctgggatcattgtctccagccggagcctgcacggaatcgaccgggtgatggaaggaatcgaagaggcggagcggatgctgcagtacgatttcttctataaaaagggattctttccggcgaaaatagcggaaaacggcgagcggctggaacggaatacaattaaaaaggaatgccggaagctcttaaaccgcgtcatgcacgaggacagggatacgctgaatcaaaatatagaccagtggttttcctttttcgatcatgttccgtgccaggacgtgggctgggccaaggaggcctgtatgagctttgttatggggctggaggagattttcctggaatactataaaaacagccaggaggagccggagatcgacagaggatggaccctcgataaatgccgggaattctgcacttatatcataggggagctttactctgataactatttgaactattcccagagtgtcagggaggcgatacagtacatccacgacaactacgggaatcaggatctctccttaaaggaggtggcccaggcggtctaccggtcgccggaatatttaagccgccggtttaaatcggagacgggaaagaatttctccgtttatctgatgctttaccggctgaatcaggcgaaggagctgctgctctacacggatatgcggatttatgaggttgcgtacgcggtgggatatgccgcgccgagctatttttcaaaggtgtatcacgaatatgtgggagtgacgccggaaatgacgagatgtcaacaaagtgacagaaagtcagaatagtgatagataaaaaagctgtggactgaaaagaagttaaaatacttcatgacaaagtacacagcttttatttatgttttaaatggaaattagtacaatatatacatgaaatacagatgaaaatcttgaaaaaagaaggagaagagcaatgaaaaagaggatcgcagcagcagctatggcaatgataatggcggtatccatgacaggatgcgccggaaagacggcagacacgaaggggagcccggaggccgccggagcacagggaggcacggaagcagccgggacacagggagacaccggtaaggggactgcaaaaatcggcgtgatcttcggtaccggaggacttggcgataagaacttcaatgacatggcatatgccggaatcatgaaggcgcaggaggacttagggatcgagttcgactatgtggagcccaatgccatcagtgatttcgttcctctgggaaggcagttctcagagacggaagaatacgatctgctaattgctgtcggttccgaccagcaggaggcggtaaaagagatcgcggaagagttcccggatcagaggatcgcactggtcgatggaatggaagagatcaccggtgtgagcacgcttcagacagagtggtgtgagcagaccttccttgccggcgttatcgcgggactggggacgaagagcagtatggacaaggcgaatgcagataacgtcattggagtcatcatcggtgcggaccagcctaatttaagagagggcatcgttgggttcacagcgggagcaaagtatgtgaatccggatgtggaagtgctggaaggcgttgtgggagcgtttaacgatcctggaaaaggcaaagagatcggcctttccatgtataacaagggtgctgactttatccagtgtatcgccggagcatccggtctgggcgtgtttggcgctgcaaaggaagcgggacgctatgcattcggcgtcggatcgaatcagaatgcggaggacccggattatatcgtggcctcttcggtcagaagcgtggaaaacatggtctataatgaagtgaaaaaggtgattgacggaacctgggagccgggcctccatatgagcggcatcagggagggcgtcgtaggctgtgacacggaaggctccaatgtagccattcccgaggagattcagacggcactgaaggatatcagggaaaaaatggtggctggagagctggtgccatgtaagacggcagatgagcttaacgcctgggtggctgaaaaccagtatacgaagtagtcggaatcgattggaggagacggctgatggttgtagttgaaatgaaaaatattacgaaacagtatcctctggttttagcgctcgatcatgtggatttttccctgaaaaagggagaaatcctctctcttctcggagagaacggggccgggaaatcgacgttgatgaagatcctttacggaatctgcaaagcggatgagggagaaatcctggtggaggggaaaaaggtaaatttaagaacgccgaagcaggcgattgatcttggaatcggcatggtgcaccagcattttatgctgactccggtcttgagcgtcacggagaatatcgtagtcggacaggagccggtaaatggaattctgtttgataaggcggcggccgaaaaggaagttcaggagatgatcgagcggtatggtttccacatatccgcatctcagatcgtgaaggagctttctgtgggggaacagcagaaggtggagatattaaaggccatctacaggaacgcgaagattctcatcctggatgagcccactgcggttctgactccgcaggaggtcgaggagctgtttcatattttaagaaggttaaaagcggcgggaaccagcattattattatcacccataagctgaaggagacactggagattgctgacagcatcagcgtgctgagagatggcaggatgatcgagtcgggtgtctccaccataggagcgactcctgacagtctggcccagatgatggttggccgagaggtggagctgggaattcggaggaaaagtgagtgcgtcggggataccaggctcacggtgcgggatattacgctgaaggaaaagggaagaaccgtacttaatcatgtgggctttgaactgaaaaggggagagattctgggtattgcgggaatcgaaggaaacgggcagacggagctgatcgaatgtctgacagggattcgtaatcctgacgttctggacatggaaaaggacggggagaagatttcaggcaagccgaaagattttatccggaaaaagatcggccatatcccggaggaccgcatgaccagggggctgatcctggagctatcgattctggacaacctgatactgggatatcaggaccagtttcagaacaggggaattctggacagaaagaagatcagaagcttttccgaggggctcttaaaggagtgcctgatcaaatcgcccaattccggggtgaaatgcagtgccctttccggaggaaatcagcagaaggtgattatcgcaagggtgttcagtgaaaatccggatattattatcgtcgcacagccgacccgcggcgtggatatcggtgcgattgaatacatacacgaccggctgctgaagctgagagacgaggggaaggccatccttttgatttctgccgacttagatgaggtgaagaatttaagtgacaggctgatggtcatgtacgacggcgagatcgtggcggaaggggaaccggcggattttgacgatatgcagctgggacttctgatgacaggcgcagtggggaaggggggacagagagcgtgaaggcagcaggattgcagttcgataaaaaagaatttctgaataaaaatatgtctgcggtggctctggttctggccctggttctgggcggaatcgccatgctggtctgcggatacaatccgtttgaggcgtacgggtccattttaaagggggcgtttatcggcaggaaggccatctgccagacgctggtgcaggcgactcccttaatctttgcaggacttgcctacacggttgcaaagaaagcgaatctgatcaacttaggaattgaagggcagctttacatgggcgcccttggtaccagcctgatcgccctgatgccagtcaatctgcctggtgtgatctggatcccgctgtcacttctgggcggaatcatcttcggcggactgtatgcgggcctggtgggctttatgaaggtaaagtttggctccaacgaggtgatagcgaccgttatgttaaataccatagcacagaattttgtggcatatgtggtgaactatccgttaaaggaagcgggaaagagcatggcgcagacggccagattttccgaatcggtgtggattccgaagctggtggataagacacagcttacggcggcgattatcatcgcagtggttctctgcgtcctgattaagcttctgtttgaacggactgtggttggttatgaaatcaagtgtgtcgggctgaatctgaaggcttccgagaccgcgggaatcaagatcgggaaaattatgatcatcgccatggtgctcagcggctccattgccggtcttctgggaggaactcatgtgctgggcgtggatcaccggctgattgcggatttctcctcgggctacggcttcgacggaatcgcggtagcggctctggcggcagacagtcccctgggcgtcatcctttccggaatcatcttcggtgcactgagagccggctgtatggtcttaaaccgtacgaccggaataccgacagaatttatcgatgtcattcaggcgttcattattctgcttgtggcagcgccgcttctcgttaaggaaattctcagaatcaaaaatggcagtaaggggggaaagaaatgatgaatcagttcatgtcaatcgttacatctaccctcagcatgtccgttccgctggtgctggcggccctgggcggagtcctttccgtcagaagcggcgtcatggcgctgggactggaaagtatgatgaccatgggggcattctgcggagttctcggctcctattatacgggaaatgtctttgcgggtctcctgaccggtatggcgggcggagcgctgtttggtctggcccacgccgttctctgtgtacggtataaggttaatcaggtaatcagcggaatcgggctcaacctcctgtcggtagcggcaaccacactgttgatgcagctcttatgggacaacaagggatcgtctccgcaggtggcctccattaacgccggtgtgttcgcatctccaatcacctatattatgctttttgccgtaatcgcagagtatgtggttctgtttaaaacacggttcggcttaaggctgcgcatggtgggggaaaacccgaaggctgcggccagcgtggggctggcggtacataagatcaagtatatcggagtcattgcctgcggcgtactggccggattggggggcgcatacctttccatcgaccacctggatatgtatgtgcgggatatgtcggccggacgcggttatattgcggtggcaatcatgatcctcgcaaagtacaacccggtcatggtcctgttctgcgccctgatattcggtttttccgatgcggtacagatcaattttcaggggtacggagttccgccgcagattatggcgatgattccttacgtggtgacgctgttcgtgctcgccttcggtgtccgccatatcacaccgcctgccggtgtcggaaagcatgatgatgaataaatactatgaggaagaaagaggataaaaatatgaaagcgataatggtaatgttcgattccctgaaccgtcatatgctgcctccctatggctgcgatgacgtgatagcgccgaattttaaacggctggcagaaagaagcgtgacctttgacaactgctacgcaggcagccttccgtgtatgccggcgagaagagagatccatacgggacgctacaatttcctgcacagaagctggggaccgctggagccttacgacgattccatgccgggtattttaaaggcaaacggaatttatacccatctgactacggatcactggcattactgggaagagggcggcggaaactatgtaaataagtacaattcctacgagtttgtcagaggacaggagggggacccctggaagggcagagtggaatgggaggttccggagcacctgggcggaagaaaggatttctgcggaaggcaggagtacatcaaccgttattacatgcaggaggaggccaatcagtcgattgcccagaatttctccaacgggcttgattttatccgggataatcacggagccgacaactggtaccttcagctggagaattacgatccccatgaaccgtatttcacaccggaaagctacaaagagccgtataaggacggataccagggcgtgatgtttgactggccgggataccatgaggtggtggagacaccggaacaggtggagcactgtatcaatgagtaccgggcgcttgtgaccatgtgtgatacgtatctgggaaaggtgctggatatgatggacgagtatgacctgtggaaagacaccatgctgatcgtcaatacagatcacggcttcatgctgagccagcataactggtggggaaagatgatgatgccgtattataatgagctggcgcatacgccgcttttcgtctgggatccgagaaccggagtctgcggggaacgccgtcaggcgctggtacagactatcgatcttgccccaaccttattggagtatttcgggcttccaattccggcggatatggagggacgtccgctccgtgagacgattgagagcgataagaagatcagagattatgcgctctttggccagcatggaattcatgtaaatatcacagacggcagatacgtgtatatgagatgtccgatgccggataaggaacaggagctctttaactatgtggtggaaccgaccagctatccgggagcaatcacggtggaggaactgaaaacggcggttctccacgagggattttcctttacaaagggctgtcccatgctgagaataaagggcggctacggtatccgtacgctgggatttccgccgagatcactgatggaatacggaactttactttatgatacggagacagatccgggccaggagcatccgctggaggacaaggcgactgaggagcggatgctccggaacatggtgcgtatgatgaaggaaaatgacgcgccggacgagcagtatgtaagactcggattggagcagtgggtctaaaagaaggattggggatacagatatgttaaatgaaagagagatcatcgaaaatagtattgggattattaggggaaagacagattttgtgcctgagatcggcctgattcttggaagcggcctgggtgactacgcggagcagattgagaatccggtggtgataccgtacggggagattccggattttccggtctccacggtggcggggcatgcaggacagtttgtgctgggaacctgcaaaggaaagaacgtcattgcgatgcagggcagagtccactattatgaaggctacagccagagaatgataacgcttccggtgcgaattatgaagcggctgggggttcagtacatggtgctgaccaatgccgcagggggcgtaaaccggaattttgatccgggtacgctgatgatgattcgggatcacatcaattattcgggcggaaatccgctgatgggagcgaactgggaagacgacggaccgcgctttcccgatatgacccgggtatatgcggcggaactgcggactcgtctgcggagcgctgctgcgaagaagggcattaagctggaggaaggcgtctatatgatgttttcagggccatgctatgaaactccggccgaggttcggctggccggaatcctgggcgccgacgcggtcggaatgtcaactgtgccggaagcgatcgtctgcgcgcactgcgggattccggtgattggaatctcctgcattaccaactttggtgccggaattctggaacagccgctgaatcataaggaagtggtggagaccgcagcgagagtgaagaagacgtttgtggagctgctggatacgattctggaggaagtgatcggatagaaaggaagaacggatggatcagaaaattttaagcgcggtggatcataccctgctgacacagacagcagcatgggcagaggtaaaacagatttgtgacgatgcagtggagtaccggaccgcatccgtctgtattccgccttcctatgtgaaacgggcaaaggagtatgtgggagaccggatgaaggtctgcacggttatcgggtttcccaacggataccagacagcggaagtgaaggtgtttgagacggaggatgcggtaaggaacggagcggatgagattgatatggtgatttcaatcggtgcgttaaaggatggcgattatgagaccgtgaagtccgagattgaggctgtgaaggcggcgtgtaagggacggattttaaaggtaatcatagaaacctgcctgctgacagaggatgaaaagattaccatgtgccggatcgtatcggaatccggagccgattttatcaagacttccaccggattttcaaaagcgggtgcgaccttcggggatatcgcattgtttaaagcccatgtggacgctggcgtgaagattaaggcagcaggaggaattggaagcgaagcggatgcagaaaagtttctggcattgggcgcagaccggcttggaaccagccggatcgtgaagctggccaagcaggagcatgtggagagcgattcctattaaaaggcatcagcctgataacagggactcatataggagcagaaaaaaacgaccaggcgttttaaacgcctggtttttcgtgtacggatagacgagtgcaagaaaaacttaattttacagatactcgttcgtgctgtataataggtaaatatatacagatttacaaacagacagaatgggaggcaggatatggaagaagacaggctgtatggatatgatggtcctgattccagaagggaaccggtggaggaagggctgacaccagcggaagggctggccggcgcgggagaaagaccggtgaatacagaggaaggaccggcgaatatagaagagagtccggcaactgcagaagagagtccggcaactgcagaagagagtccggcaaatgctgagaaagaactggcgaatgcagaagaaccagcagcagaagacgcagctgactgttacgacacgcagaacagcggaacgggatcggatttccatgagttgaatggatatccggataccggaagcagacagtatgagagctggggcagagaagaatacaggcagaacgataactggcagcaggacaaccgtgagaggggcgactggcagcaggacagctggcagcaggacaaccgtcagcaaaacaactaccagcagcccaactaccagcagcccaactaccagcagcccaccccccagaacagctattaccgggacgaataccggcaggcggctaatcctgcgtatacacagcctcaaaagcagagcagcatggcgttggcttccctgattatggggatcatcggaatcgttacatcctgctgctgttacggcggggtgatttttggcagcctgggaatcctgtttgcgctgttgtccaaaatgggagatacgatggagggatatgcgaaggcaggtctcattacctcgattatcgcgctgtttctggcggccatggcaatgatatttctatttggaatgatgagttcatcccttctgtcaggaggtactttttaatgaagacaacgtcaacggaactgaaaaaacgtgcgaagcttacgctgtcaggcaactatggaacagccgtgggcgccatgctgattgtgtatgtccttctgatcgtcgttattatgatttttatcggtatatctgcagtcagcacactctcctggatcggcaaacccggcttcaaccggggaggctggatgcgctcactggcaatcgagatggtgatttatttcattgcgatccttttggtttacctcataatggtcggaatacgaaggatgttctaccatatgtgtacaggccagccgtattcactgggagatatgttgtttgcctttactcacaggcctcaaagatttttaggcgtttactttatcaacctggtatttggtatgatcattggaatcccatattttgtggtaagcgtttccgcccgtattacgggttatatccccatactggcagcgcttcagtttctgatgtatctgcttcagatagtcggaatcgtcgtgtatagcctgcattttaaaatggcggtttaccttctgatggaagatcccgagcggacggtgatcagctgcttccgggagagcgcggcgctcatgaaagggaacaagggccgcctgttttatctgggaatcagcctgatcgggatgtatttgctggggttcggatcgtttggaatcgggtttttatggattttaccgtatatagagacgaccatgattcacttctatctcgatatgagcgatggaccgcgccgggaagaagcatatgattacgaggaaccggtttatgacggcagaagctgtgacggcctttacggaaatgtaccggagtaataatttgtatcacacataggaaatgcgcatagaatacactaaggaatatagaaggtgcaggctatgcgcatttcagatcttaaacaaaaagaagtgattaacatctgcgactgcaaacgccttggctatgtgggcgacgtggattttgatatggatacgggctgtcttctggcgattatcgttcccgggccgggctgcttctgtggatttctggtcagagaaaaagagtacatcattcccttctgtgacatctgtcaggtggggagagatattatcctggtgaaagtagatctggaaaaagctgaggaaaaatgcaagatatagtgtaatatgtgcttgcgaatctacggattgtggggtatgatatacataattaaaaagtaacggatccggagccgcgaaaaaatgtgtattttttttcgcggttttgggccctgcacaaaaaacagtgggatttctcatttctgaaaagaaggaaagagaaatcgcccaacaggaggatagcgacgtgaaatgtccattttgtaatgaagcagatacaaaggtcattgattcaagaccggcggatgacaacagctccatcagacgccgcaggcagtgtgagaaatgcggaaagagatttacaacgtatgaaaaactggagactctgccgctgatggttattaagaaggacgagtccagagaagtctatgaacgttccaagctggaaaaaggaatccttcattcctgccacaagcgtcccgtttcttcccagcagattgattccatggtggacgagatcgagacacagatattcaatatggaagagaaggaagtctccagctccgcgatcggagaacttgtcatgaaaaagctgcaggaggtcgatgaggtcgcatatgtccgtttcgcctccgtatatcgtgagttcaaggacgtgaatacgttcatggaagagatcggaaaattattgaaaaagtaggaagatgtatgtttaacagattttatccggatgaagacgtggcctctgcgtatgacattccgtatgacgccctttataaaaagggaatcagaggcgtaatctttgatgtagacaacaccctggtgccccatgacgcgccggcggatgagagagcgaagaacttgttttctcatctgcgggcgcttggcatggacacctgcctgctttccaataacaaagagccgcgggtggcagcttttgcagaagctgtcggcggctctaactatatctataagggcggaaagccgggcgtgaagaattataagaaggcgatggagctcatggggacgagcttaaacagcacgatattcgtgggagatcagctgtttaccgacgtctacggggccaaacggacgggaataaggagctttctggtgaagccgatcaatccgaaggaagagattcagatcgtattaaaacggtatccggaggcacttatcttatttttttatcgcagggacaaaaagaggagacagtatgataagcggaaaaagtaaagtatgcggagtcatggcgtatccggtggagcactccatgtcaccgctcatgcataattattactcggaaaagacaggaacagatctcgtctatgtaccgtttaaggtggagccgggacgtgtggaggaagcggtaaaaggagcctacgcccttaattttaccggcatgaatgtcacggttcctcacaagcaggaggtcatgaaatacctggtggatattgacgaggacgcaaaagccatcggtgccgtcaacacgctggtgcggaccgacggcggctacaagggctataacacggacgcggcaggactgaaacgagccatgacggaggcgggaatcgaaatccgggaccgcacctgcatcctgttcggagcgggcggcgcggccagggcggcagcctgcgtgctggcgaaggaaggcgcgtctgtgatttatgttctgaaccggagtttggaaaaggcggaggccctttctgagatcgtcaatgagcggttcggccgcagagtcatgcttcccatggccctggacgattacggaaagctggagtgcagctcctgcctggcggttcagaccaccagcgtagggatgcatccgaacgtggatcacgccccggtggaggatgcggaattctataaaaagatcgatacggcggtagacattgtgtatacgccgatggagacgaaatttatgaaatacgtccgggcagccggcggcaaggccgtgggagggctcgatatgctgatttaccagggcgttatcgcctacgagctgtggaatccggagaccgtgtttaccagagagatgatcgacggtgcgagagtgctgatgcgggaagaactggaggctgcgcgatgaagaacgtgattttgatcggcttcatgggggccggtaagacaacggtcggagaacggtacgcaaagaagcacggtctccccatggtggatacggactggctgatcgaagagcgggccggcatgacgatatcggagatatttgcgcagaagggcgaggacgagtttcggaggacggagacggcggttctccagacgcttctttccgatacacaggaaaaggtcatttccgtcggaggcgggctgcccctgcgggaagagaatagaaggctgctgaaacagctcgggaccgtgatctatctggaggtgaatccggataccgtgctgaaacggctgaagggagatacgacaaggccgctgcttcagggcggagacgtgacgcggcgtgtggaagagctgatcgcggcccgcggccccatataccgggaggccgccggactgatcgtagatgtgaatggacggagtgtcggtgagattgtgacggagctggaagaaaggatgggatttgaatgaagctgcttcttttaaatggaccgaatttaaattttcttggaatcagggaaaaaggtgtatacggcactgaggattacggatatcttgtccgtatgatgaaagagaaggcggagagagaaggacatgaactggatatttaccagagtaacttcgaaggcggcttaatcgataagatccaggaagcgtattataacggaacggaaggcattatcatcaatccgggcgcgtttacccattacagctacgcgttgagagacgccctttcctcggtggatattccgaaggtggaggtacatatttccaacgtgcataaaagggaagaattcaggcatacttctgttacggcgcctgtctgcgacggccaggttctggggctgggactgaagggttatgcccttgccatggactatttgacaggccgtgaataacggcgtgtatacagaaaatgaaaaaaatagttgaaaaaggtattattatagtatagaataaaaaggattaagagaatttcaaggaggaatatcatttatgatatcagcgggtgattttagaaacggtatcacattagagattgatggtaatgtttatcagattatggagttccagcatgtaaaacctggtaagggtgctgcatttgtcagaactaaaattaaagacgtagtgaacggcggtgtagtagagcgtactttccgtcctacagagaagttcccggctgccagaattgaccgtgtggacatgcagtatttatatgcggatggcgatcttcataactttatggatacgaacacttacgagcagatcgcactgagcccggaagtaatcggagacgcattaaagttcgtgaaggagaacgacattttaaaggtttgttcttacaatggcaaggtgttctctgttgagcctccgttattcgtagagctggagatcactgatacagagccaggcttcaagggtgatacggcacagggcgctacaaagccggctaccgtagagaccggagcagtcgtttacgttccgctgtttgtggatcagggcgataagattaagattgatacacgtactggggagtatttatccagagtataagaacaggatacgccgcagactaaagcaaaagacggtaaaagagtgtggtaaatgttggcctggaggccagcatttactaccctcttttaccgtcttttttgtattgccgaagcattggtaaccgttcaaacattgacaaagagggggaagacgcggtaagctggtaagaaatggagatgggaaagggaggattttatgtttcggattttgctggtggatgatgaggcgcaggagagggatggaatccggttcctgattgaaaaatataggctgccgctttcggtagtggaggcgcagaatgggcagaaggcgctggagtatttgaaggggcatccggtggatattctgtttaccgatgtgaagatgccttataaggatgggctggagctggcgaaggagacgtttcagtttaatccggatatccggataattatcttcagcgcgtatggggaatttgagtatgcgaagagggcgatggaggccaacgccgtggattatttgctgaaaccgattgaactggacgagttcgagaaggtcatgaataaggtgatcggggatctggagaggcagagagaggagtcaaagcaggaacaggagcagaaggaagcttccatgaagcgggtgttttataaggtgtttacaggagggagcgtgtcggcgtctgatctggggatgctggaggagtattttcggacgattggaaaggaacggaaggtgcttataagcctggagagcgggcggaatatttttgaacagcaggaggaggtctttttgaagctgctgcatacatatatccgaattccatccgaatatgtgaacctgtatcccgattcgtcggtggtgcttctggccgatgagaaccggatcgtgggaagcgggctgcagaagcagctggagaaactggccagggacggcagacagcttctggggactgagatctctatcgtggtcagcagggaatttactacggtggaggagatgaaccggcagatggaggagatcagccagattcggaagaatttctatgggacgggcggtgagatcacgtttctgtctgagattgtattaaattcggagtattatgccgcggaggtggagcggattaaggaactgatgatcgaggcgattggggacaggaacgacgatcttgtgatcctgtacggagatcagctggtggagacgatggtgggcggccatgtggtcagccggatctatgtgcatcatgtcttttacgatattctgtcggcattttacagccagtatggagtcaatgacaagccacggctctttgagagcgtggaacggctgctgtcctacaaagatggcgaggagctggaggtgaatttccgggcagtcttaaatgaggtgctggcaaaacggacggacgccgtgggggacagtcccaggatcgtggaacggatcaagaatattgtcagggatgaatacaggagcgatatcggacttgaagatatcgccgagcgggtcaatctggctccggcctatttgagctatctgtttaagaaggagaccggggcaaacctggtcaaatatattaccgattaccgcatggaacaggccaggaagctgctggaggatgaggaactgaagatcgttctggtggcaaaggcctgcggatatgagaatcagccgtattttaaccggctgtttaagaactattacggaatgacgccccggcagtaccgggagaagaatggaaagcagcagggatgaggatgaaacgattgctgaagtggtattatggaagcgcctcgatccggaagaaactggtgatcagctatctcctgctgattaccgtcccgatcctggtgctgggagtgtactcttattcggtgtcgaaacgcaatatggagcggcagacggaggagaccatacggaataatgtacggctgatggcctccgatttggagacctcgctgaagagggaaaatgacaacatcaaatatctgtcttataacgcaaaattccgccaggtgctgaaaaacagcaggggaaaccaggtggaggtggctcaggtgctcaacgaggtggtcgagccgatcttctggtattttatcaccagcgatcacaatatgaaggggatcgagatctacacgccctatgtgagccaggaggtgggaagctttttaaaaccggtgggcggcagcagtgaggaatcgtggtaccagtatcatcagaagaatttcgggacgctgtggacgtatgaggacggcagtatgttcgccaccaggacgcttctggacgcccagacggcatcagagcccatcggtgtgctgaagctgagcgtccatccggcgtcggtcctggagccgatctccagtaatacatttttaaacaacgggattctcctggcggatacggagggaaggcccatatattccagacagacggggacggagcaggcggatcagtccgtcttaaccggggcagaggcgggaacgcttcacgacggcgaccagggggactatattctgatgtctgaggagatcaccaccagcggatggcgcctttactactatgtgacgaaaagcgagatcacagggcggctgtatgagatcctgaagtccacgctgctgatcgtgggactatgcctggcggtcagcctgtttctgatcggtatcctgtctaaggttttaagccgcaggattctggaactgaaggagagcgcggagaaagtggcggagggcaactttaatctggaactgaaccacaacgattccgacgagatcgggatcgtggcaaagagcctgcagaccatgtgcgaccggctgaatgagatgatcaaccgggtctacaaggcagaactggaaaagaaggccatggagcttaaggcgcttcaggccatgatcaatccccatttcctgtataactgtctttccagcatcaaatggaaggccatccgtaccggcaatgacgagatcagcgatctcacggggctgctggccaagttctaccgcaccagcttaaatggaggaaaacagattaccaccgtggggagcgaactggaaaatgtgaaatcgtatgtggagcttcagcgcatgacccatgaaaacagcttcgacgcagagtatgagtttgatgagacgcttctcggatattccatgccgaacttccttttgcagccgattgtggaaaatgccattgagcacggcattaactatcaggaggagatcgacggaaaggggcggctgatcgtgcggctggaggaagaggacagccatctcatcttcagtattttaaacaacggcccccgggtggagctggaacggctggaggagatattaaacacgccgggcaagggctatggaatttataacattgaagagcggatccggatttactacggagccggatgcggtgtctacgcatccgtcacggaagacggctatacgaattttacggtgaagatattaaaagaactgaaggagctgtccgtatagatgggaagttctaaaaatagtgcaaggtttctaaaaaatttgttaaaaagtcttcctccgggagatggtaagatagagacatcaaaggaatcataacaaggaggaaggtaacatgaaaaggaaattattaagcgttctcttatgtacggcgatgactgcttctgctttggcaggctgcgggggctctggagcttccggcacggaggcggccaaaacagaggggggagaggcgaagacagaggctgctgccgataaaacgggggcggacaaggtcaagattcgtatgacgtactggaacagtgaggacaccatgaaggcgatgctggattatctggcggagacgcttccggagatcgagattgaataccagttcatcgacaattccaattacgataccatcgtagatacccagctgtcggcgggagaaggcccggacatcatctgcgaatcaccgggatcttccttaaagcacgcgagactgggctatttagagccgttgaatgatttgggggccgagtattccagcgccggaaccagcgtctattcctatgacggaaacatctatgcgctgccgggaatcagctggttcgagggaatctattacaacaaggccctgtttgaggagaatggaatcgcactgccgaccacattcgacgagtatatcgcggtctgcagggcgtttaaggagaaggggatcacccctctggcagcaggcttaaaatcctgggagccaatgctgaaaaactccatggcgtttgtgactgcggaatacttatccacagacgcagggaagaactttggctccgattaccgggaaggcaaagccaaaatggaagggacatgggacccgtacgtggaaaaatggtctgagatgatctccgagggcgtctacaccacagacatgacgggaatcgaccacgatcaggcattagagcagttcgcaaccggaggcgcggccatgttctgttccggtccctgggatttggataccatcaccagcaagaacccggatctccagattgatatgatgccattctacggaaccgccaagagcgatggatggctgatcggcggccctggatgcggatttgccgtaaacagcgcctctgccaacaaggaagcggctatgaaggtggcccgcgcgatctcaaccgtggaaggccagaaggcactgtgggaaaacaaccagggcggctcttcctacttagaaggcgcatccttcgacttaccggctgcctacgagggcgtttcgggaaccctggcggccggcaatgtatactgcccgtggaatgagtggggcgcggcagccggcgctcatgagacatacggaaccgagatgcagagctatctgttaggttcccaggatttaaagaccacattgtcgaatgtggacgcggccgtggcggagcttttggaaaagtaaggctggcactgacgaacgataccgatgatgggagcggcaatccatgctgaaaagaatattggcgtacgcatggaggacgctccctttttgcgcccatttttgggcgaattgaagaaaaggaggggtatgaaatggaacagattcaaagaaaaaggaggcaggccggaacgctgggaaagtatttctatgtgttcatcctgccagctttcatcgtatatcttctgttttccatcgttccgtttttatatacgttttactacagcttcaccgattacacggatatgaatccggtcaacttaagctttgtaggcctgaaaaattatataaaggttttcaacacgccgctgatgatgacggcgataaaaaattccgtaatttatgccatcatgctgacgtcactccagaccattctcgcgctgccgctggcggtgctcctggataagaagctgaagaccaggaacctactgagagccgtattcttcttcccgaccgtattcagttccctgatcatcggctatctgtggaacttcatcatgtcgtcgtcggattacggcctgatcaacaacctgctgcatcagctgggcttcggaacctttaatttctttacggctaaccgggcgctgttttccgtcattttaacccaggcatggcagtggaccggatgggccatggtcatctacctggccaacttacagagcatttcaccggatctctacgaggcagcggacatcgacggagccggagggatcaagaagttcttttacgtgacactgccgctgatgtgtccgtcggtcaagatcattgtggtgaccggcttaatcggaggcatgaaggtcttcgacatcatctactccatgacatcgggcggtccgggcaatgcgaccgagacagttatgacagtcatgatgaaaaagggcatctcggacggcttttacagcactggatcagccttcggcgtgtgtttctttgctatcgtgctggtgatcagcgccgtagtcacaaaattaatggggaaatggagtgattcgatacaatgacgaagagaaaaagaaatttatatgttctggaagcagtcatgctcgtgattgcggtgatctggtttatcccgatttactatctgatcgtaacgacgcttaagaatcctcaggaggccacggccaatcccctgggactgccgattcacttagaaatcggaaattacatcaaagcatggaccaatatgcagtttccgagggcgtttgccaatacgctgttcatcacggccacggcggtcgttatcatcgtcgtgttcggcgccatggccggatacgctctggcgagaacgaagacgaaaatgggcaaccgcatgttcctgttcttcctggcgggcctgatcgtaccgtttcagatgaatattgtcagcttatataagatcgtcaagagccttcacctgatgaacactccgtttgcagtaattctcgtcaacgtggccatcaatacgccgcaggcggtattcctgtttaaggaattcatagagggaacggtgccgaaggaactggaggaggccgcggagatcgacggctgtaccgtgttccgtaagtttttcagagtggtgctgccgcttcttacgccggttatctcgacggtcgttatcatcgtcacactgaacgtgtggaatgaattcatgacgccccttctgttcctgcagagccgcgagaaggacgtaatccttcaggaggtgtcccggaacatcgggcagtttgccacagactggaccgcgctgttccccatgctgatgctgggcgtggcgccgctcatgatcttttacgtgttcatgcagaaatacataatcgccggtgtggctgccggcgcggtgaaaggataatggaatatggataagagagagtctggaacatttcccgggagcctgatggtgatcgtaccgcatcaggatgatgaaatactcctgtgcgccggtatcctctatgaggccgtccggagaaagattcccgccactgtcgtgatggtgacaaacggcgattacggatgccgcgattattcgattgggcggagccgtttaagagagacgcttgccgggcttgccatgctgggaatcgagaaggaggatgtggagtttttaggctatgccgacacgggaatgccgaaggaagaaagcttcataagccgcctctatgaggagacggatgagaggagacgccataagtcccactgctcggaggagacctacggcctggaagagaaggaagagtaccataaaaagaggtggggaacccatgcgccatacgacagggcccatctggccgcggatctccacggtgtgatagaggagcaccagcctgatatgatttttaccacttcggagtttgacactcatggggatcacagtgcgctgtacttatttgtccgtgatatcttagtgcagatgaaggcggaggcggaggccgggaaggcggactgcaagagtcagccggtaagcggggagaggcacgcacttccccgcctgtacagcggaatcgttcattccctggcgggagatgagaactggcctgtcaggaccagggaggtggggccgtatacagagccggcccagttccgggagacctcctgtttccgctgggaggaccggatccgctttccggtccccgcatgcatgaggacggaggagcgggatgtgaacctgaagtatcaggcgctttcctgtcatgtcacggctctgaagccggatgcggtggactttttgtatgcatttatcaagagtgaagaacttttctgggagattaattactgaaggagcgagacagaatggaaattaacaaacagccgatctatcccgtcgagccgtggacggtgacggaaacggaatttaagatggagacaaattaccggaatgagacgacattttccctgtcgaacgggtatctggggacgagaggaaccctggaggaggggtatgacttcacggtaaatgagggactggaaggcaattttatcaatggattttatgaaagcgagccgatccgctacggagaatggaactatgggttcccgacagagagccagtcactcctgaatcttcctgatttaaagacgatcaggctcttcctcgatggggaagaactggatatcagaaaaggggaggtgtcaggctggcgcagaacacttcacatggaccaggggacagtcaccagatcctttgactggacctccccggcgggacggacggttcacgtggatacagtcaggcttgtaagcttcggggtgaagaacctgatggccatgtcatacgaagtgacaccggtcaactttgacggagaaatcacgttcctgtcggttctggacgcgaatgtggagaatcatacacggaagacgaatccgctggtggattacggccccttcggctgctgtctgctcaccgacaggatcaccgcagatgaatccatgctgttttatcaggggacgacggagcacagcggccttactatggcctgcggcagtgtgatgacggtgaagtccccgctgacacaggagtggagcgtcacggaggacggccttcactgccgccataagatagccgttcacggaacgaaaggtcagacgatcactgcggaaaagcagatagcctacacctcctctctcgatctggaaaagaacgcgatgagagattttattctttctatattaaaggaggcggtaaaaaaaggctttaagagcgaggcggccagtcaggaggcctgtatgaaagccatgtggaatcaggcggatgtggtgatcgagggagatgacgcgctcttgcagggcatgcggttcaacctgttccatatccttcagtctgcttccagagacgggaaaaatggcatgggcgccaagggtctgtcgggagagggctatgagggccactatttctgggatacggaaatgtacgtaatgccggcgctgatttataccaacgcagacctggcaaagtctcttctcggctatcgttaccggacgcttgacgaggcgagagacagggccagggttctggggcatgagaagggcgcgctgtatccctggcgtactatcaatggtcaggaagcctccacttatttcccgctggggacggcgcagtaccacattaatgcggatattgcctacgcctttaagctgtatctcgatgtgaccggagatatggaatttttaaaggatcaggccgcggaggtgctggtggaaacggccagagtctgggcggatgtcggctgtttcgctgagtccaggggcggtaagtactgcatctgcgccgtaacggggccggatgagtacaatgccattgtggacaacaatttctatacgaatctcatggcgagggagaatatccgcgatgccgggtgggcgcttgacacactccgcgcaatggatgaggccgcctgggaggctcttgtggcgaagctgggggttaaggaagaggaacgggcgctctggaaccggatcgtggagaacatgtatttcccctacgatgaaggcaggaaggtctatccgctggatgatggcttcatgatgcgcaagccgtgggacgaatcgaaaataccgccggagaagcgccatctgctctatgaaaactaccacccgctctttatcttccgccagcggatgtcgaagcaggccgacgccatactcggtatggtgctgcacagcaattactttacggaagaggaactaaggcgcaactacgatttctatcaggaggtgacgctgcatcactcgtccctttccacctgtatcttcgggattctggcctgccggatcgggtatgaggaagaggcgtatacgtatttcgcccagtcggccagaatggatctggatgattaccacgacaatttctatgcgggaatccatgcggccaatatggcggggacttggcaggcggtggtcttcggtttcgccggcctgcgcgtgaaccggggattcttagagctccatcccatccttccggaaaagatgaaggggtacgagttccggttcatgtaccgcggccgcctgcttcacgtgcggaccggacgggaaggaacaagagtgacgctgctgtcgggagacggcgtcgtattatggctgggagatacccggcatcagcttttaaaggagggagactatgtctgttgttaagccacgggccgtattctttgactgggatgggacggcggtttattccagaaaagcgccggcagacgcggcgttatccgccatgagaccgctgctggctcagggcgtcaaattagtgatcgtcagcgggacgacgatcgaaaacattgcaggagggcagcttgagaaatgcttcactcctgaagaattaaaaaatttatacctggggctgggaaggggcgcttataattacgcgtttgacgatgaaggaaggccgtatgtttttgccgaccggctgccggacagggaaggccttctggcagtccacagcatctgtttcgatatccataaggagcttttaaagaagtacgatttccctaccgatatcgtattttccaggccgaattactgtaagattgatttgatggtgtcgagccagagaggagatcagctgtttctgcaggaaaatgagctgctgctgttaaaggagagcttaaagcgtcacggaattgagggcgggctgtcaacgcttctggagatggcaaagactattggggcgtcgtatggaatcacggtggcgcccacctgtgacgcgaaatatctggaagtgggactctccagcaaaagtgataatgtggacacgattctcggcaggctttggcaggaattcgggattctgccggaggagtgcagctactggggcgatgaatatgtggggattgaggaaggtatctttggaagcgacagctttatgattacggagaagtcgaagcggggccatttctttgatgtttcggaggtcccgggagaacggccgcaggaggtaagtgtgaccggaggcggagtagagcgtttcctggagtatttaatagaaattaacaaataagcaagaaaaagcgtaccgtttgagccaaccggaccgaaagaggagtcctggcaggctgaaacggtacattttatttgacttaaagtacgtttaaaacaggttataaaaatatttttaaaacgaagttacagatatattgataaaattcgataaaaatgttaaaatataacttcaatggcaaataaaagaaaaaacagagaatgatatcgcagataagagaaaacagaacgggatatcaaaagtgaaacacagaggaggaaaaacacgtatgaagagagcagccgcatgtctgcttgcattgtgcctggtcgtacagggaccggcaagtctgatgaccagctttgctgatttcgggcagagaggagtggcgtcaccgtcgaacagcgtatcggcgagtccttctgatgcctggaaagagagtgacagcgacagtaagaatggggaattaaaggtagaaattcgtggagtccttcctgtgcagaaggccgcggaatgggaattgtttctgacaaaggacgaggaactgaccgatcagggttcggtgcagtatgaggccgtggaatcggccggggtctattcctccggcagttacacatttacagaccttccgaaggggaagtatcagcttcaggtgaaggcggtaaatggcggttatgaggactacatacagaagaatatttcaattaacggtgaccgggcgtcgattctgcttttaaacgactacccggacaaatacggctatgccggggataaaatgcccggtgtaatccggatgggtgatgtgaatggtgacggaacgatcgacagcgatgatatggaggctttcattgacgccattgatgaagcagacggtaatttcgcagattccaggttcgattttaatggagacgggcagatagatcttgtagaccttcagtattttaccatcttctataaaaataagagcaatacaaaggcgactgtaacgaggcaggccctggtggataccgctgctgttgttgcgtcatccagcaatgcgtcgttctccgaggagacgctgaaggaagtatttgccggaaatgacagcgaggcgttgacgcttacagcggagacggcgatcacaccggaaacgccaattgagatcaccgcagacttgggacagagcttaaaggcggaaggatttacaatccagccggttacaggttccggaaacaccatcaaagacggctgggtcacggttgaattggaaggcgaagagaagcctgtcgtattcaggattgagaacggcgtggcggaaagacagacagggacaaggatgcgcgcggcctttagaagcgcgcctgaggattccgccgctggtaagaccattgtcatcaatttgggcaaacaggtggcgatcaagaaggtgacgatcaaagtgacggctgcattagaaaaggaggccactctggtcgagatatccaaggtggaattcttaaatgatatggagagcagaattccggagccggagatgaacatcccggaggacttaaaggctgtggcaggcagcgaatcctttgatttaacctggaagcgcgcggtaaatgtaaccggctatgaggtcgagattaccggtgaggtaaaaggcggagtcaagtctgaggtgctgtcggtatcggacaaccgtttaagcgtaaagtcaataaaaaatgaggacctgataaacggaaaagagtataccgtgcgggtgcagtctgtaaacggggcgtggagaagcggttacagcacggctgtgaaggtgacgccggaagcctccaaacggcctgatccgccggagggaattacggtaaagggcagttaccgcagcctcgatgtgtcctggaaaaagatgaaggatacggatacgtattctctgttttaccgggaatacgatgatgccgacggtaaatacaccagaatcgacaacattgaaaataccagccagatgatccagaatctaaaggatgaaacaaagtacgatatctatctgaccggtacgaacaaaattggggaaagtgcgccttccatgcactacagcggaacgaccgagagcgtcaatgcccccataacgccaaactacaaactgatcaatgtggcaggggagaatggcggaaccgaacatatcaaggcggtaaacaatcacggcggaaatgccgacagtgagtttgcgattgtggacaacgatatggtatctgcgtgggtgcgcaacgactgggatgcgggctgcgtttacccgggagaatcaaaatcaccaacggtgaccctcgacgacagctatacgatggacaccgtggtccttattccggatccggctcagaagtttgcatataccaatgcgaccttcttctactggccggagggaagcagcacacaggtgcaggcagcaggcaccttcagcagaaaaaccagctctaacggaaaagtatattatgaattccagacgaaacagccggtaacgacagaccgggttcaggttagactgacggcaggatacggtgcggccaacagaatcagcattgcggagatgaaattctatcactacgatccgattgagcatgaggtatacgatctgtttgcagacgatatgcacatttctttgaaggaaggggtgactcaggagcttattagcagtctgagggcgcgtctggatgagaaggatgaggtaagcggggaattccatccgaagaaagagattctggagagagaactggatacggcagaacagcttttaacggatgaggctctggctggaattcttactatagataatcacgtaacgaaaaatgcggacggcaatattacttttaaaggcggattaaacgcctggcagccgcttggcatcacagccatggccggagacacggtgctggtctatgtgggcagcccgtccaggaagactggagacagcacgaatctgcgccttatagcgactcagtatcacggggaatccagcgcatggtcgaacacgatcggcacgctgaaagcgggaatcaatgagataaccatcccccagatcactgccctcgacgtggagcagggcggacagctttacatcgaatataccggtgatcaggataaggagacctacagtgtgagagtcagcggaggaaatcacattccaacgctggatataacaagagcttccgattccaatgcgaagagagccctggtgacgaagtatgtggaagatctggaggccagcacagcggagctggaagcagaccatgagaaccataaaaaagcgcatgacggagactggagcgctgcgcggaaaaactgtattctgggcgccacggatatcgtaacgagatatatgatgtattccgtttcctcccagcagatactcgccggattatcaggcggaactacggaggaaaaggcggagcagctgtatcaggcgctgacggcggccgatgagatggtaaatctcttctaccagcacaagggactgagcagtgatcccgatgccggagtgaaaaataaactgccggttagccggctgaatctgcgctaccagaggatgtttgcaggcgcatttatgtatgcgggcggactgcatatcggaatcgagtggggatccgtaccgggccttacaaagtccgtaccggtgaagacaacgccggaaggcaaatacgaaagcggccagtactttggctggggcatcgctcatgagatcggccatgaaattaatgaaggcgcatatgccatagccgaaatcaccaataactacttctctgtgctggcgcaggcccgtgatacgaatgacagcgtgcggttccagtatccggaggtttataagaaggtgacgtcgggcgtaacggggcggtcctccaatgtatttacacagctgggattatactggcagcttcatcttgcatacgatatgggcggttataactataaaacgtacgatacgtataaggaacagttcaacaatctgttctttgccagagtagattcctacgtaagaaatccgggatcggcgccgaagccgggcaacgtggcgttaagcgtaagcggagatgtggacaacaagctcatgcgtctggcttgtgcggcggctgaaaagaatattctggagtttttcgaacgctggggtatggtgccggatgagaacacaaggaagtacgcggagcagtttgagaaagagacaagagcgatctggtttgtaaacgatgaggcaagggcttacgtgctggagaacggcaaaaatggttctgtcgcagccagcgccacggtcgaggctgacttaagctacaggccgaattccaacgaggtgacaattcatctcggaagccagtcgaagcagccggaggcaatgctgggatacgaaatctaccgttccgaaaccatcaagagccatgtagagaagaaaccggtcggctttgtgaccgcggaccagacagaatttgtcgattccatttctactattaacaacagagttttcacctacgaagtggtaggctacgacaagtacttaaatgccacaaaaccggtggtactggagccggttaaagtctcccacggcggtgtgattgataagtcagactggaccgtgaccacaaacatggtctcggcagaggacaaagtggatgaggagataaatccggatgtggtaaccatggaggccatcggaaaggtcatcgacaacgatgcaggaaccacctatacaggaaagacggtagccggaagtaacggaaaagtacctgcggcctctgtcaccattcacttaaacagagaagagaccatcaccggtttcacgtataagctgagtaaggcggataacgcggccggaagtccgatcggcaattttaaagtggagatcagcgataccggcgcagatggttcctggacccaggtcaaggccggaaccttcgccgtagcgcagggacagctggcgaacggcagtcagaccgtctattttaacaagaatgacgacacctggctgtatgcctatgacacctcatacgtaaggattacggcggtggaccagaagggaaccgatatttccatttcggagattgatctgctggggcagaccggagacgacatcgactttggtcagacggattcgattggccttttgaaagaggattaccatgccggacatggagagagcggcgaggccgttattccggcgggctccctcctgttcacaggaacgtataaagggaatccggcgtacaatgtggtcctgctgtatgatgagcagggaaagattgtgggcggtaccgatgcagaaggaaatatattggcagcacagatgatctttgcggaagtgccggagcacggagaactgggtgagaccagcagcggaacgtggatctattacatcgaacccgaaaaccttaaaaatgccgctcttccaaaacgtgtgagagcggagctctaccgggtagacaacgcacatgacaacaggggagaacgtcttgtcagcaacactctgtttgtcgatgtgccggagacactgccggagatcgagataaaagcacaggactgaacgtacaggaggagaaaatatgttgcagcgacttatgaataagaaagtaataattggcctgctgggaatcctgatcctgcttgcagcgtttggccgtattatgacaacaccggcggaggaataccggtttgtcacatgggaaaagggaaccaatgatcatgaagtaaaagtgagtatcatgctttctgcacgggaggacgtgcagaaagcgggaacctttcaggttcagctcggcgttgcctccgatgattcggatgggatagagagcatagattttaagttcgacagcgctataaaaaacaattctgatattacggtgcagtcgtatcgctataaccgggataacggaacatttacgatctacgtatcggggacagcggatgatatcctgaaaaagggtactgcgttgaatcttggaacgattgtggtaaccgcggacagtgatgtgacgttttcggttaagacggaaggctgcaaagtagccgatgaatcgtttacggaaagaacgctcactgtgttcggaagtcaggacgattatacggttaagcgggatgcggcagatgatgagacgccggatggcacggcaccggatgagacgccggacggaacgacgccggacgagacgccggatggaacggtaccggacgagacgccggacgaaacgacgccggacgagacaccggatggcacggcaccggacgagacgccggacggcaatgtaccggaagaaaagccagagcgggaagattcctcaaacagtgtgtggaatgatccggaagaaacgagcggaagctggaaggcaaaggacggaatctggaacttcgaaaaggaggacggtacctatgcgcagagcgagtggatcaaagtcggcggagaatggtactggatcggtgctgacggccggatgattaccggttggattcatttaaacaatgtctggtatttctgcagcccgtcaggggcaatgaagaccggatgggtcaataccggagaccactggttctatttcaacccgtccggagcgatgaagaccggctgggttcaggaaaaaggctattggtattatatgggagaatccggagcgatgaagaccggatgggttcagacagacggaaagtggtactacctggatgaatccggccatatgctggcagatacagtgacaccggacggcggcagagtcgataaaaatggtgtcagggtcgattgaacagcagaataaatggaataacagaataaatggaataacagaataaaaaatgcgagggactgttttaggagtattcttaaaacagtccctcttcttgtattaaacgcttacaattttgagcgcctccgttatcgctgtttcattttcctgcacaaaatgaaacagctttgccgcgtcctccgtgcagcgcacgtcggaaattccagtgaacctggtatcttgtctgcaatgcagtgctatgatgccagtataccatataaagaagtcgggaggctgctcagtcactattctgccaggaaaatgatcacggcttccctcggactcccctgcttgcttatatacaaataaacataagtttgcctggtatggagtttgatatttcattcaggccatggtaaaatagaagctaaataaatggatcgaatgaaaaaggtggttgagatatgatggagcaattatcgctttttgatgaccgggctgccgtggggccgctggcaagcaggttgagaccgagtgggatggaagagtttgtaggccagaagcacctcctgggagaggggaaggtgctgcgccggattattgatcaggacatggtgtgttccatgatcttctggggaccgccgggagtgggaaagaccacgctggccagaattatcgccaaccggaccagggcttccttcgtggatttttccgccgtcacaagcggaataaaggaaataaaggaagtgatggcccaggcggagcgggaccgtcatataggtctgcgtacgctcgtatttgtggacgagatccaccgctttaataaggcccagcaggacgcatttcttccctatgtggaaaagggaagtatcatcctgatcggagcaacgacggagaatccctcgttcgagattaacgcggctcttctctcgagatgcaaggttttcgtactccaggcactccagaccgatgacctggtaatgcttctgcaccatgccttgacgagtcctctcgggctgggggatcagagaatcgggattacggaggacatgctccggatgatcgctcagtttgccaatggtgacgcgagaacggcactcaatacgctggagatggcagtcttaaacggggagatcagcgcggaggaaaccacggtgacagccgaggtgctggagcagtgcatcagccgtaagtcccttctgtacgataaaaatggcgaagagcactacaacctgatttccgcccttcacaaatccatgagaaacagtgatccggacgcggcgctatactggctcgcccgtatgctggaggccggagaagatccgctctatgtggcaaggcggctgatccgttttgccagcgaggatatcggcatggcggacagccaggcgcttactctggcggtctctgcctatcaggcctgccattttaacgggatgcctgagtgcaacgtcaatctggcacacacggtgatctatctgtccatggcaccgaaatccaactccgcctacgcgggctacgaacactgcaaggaggacgccctgcatacactggcagagccggttcccttagtgatccgcaacgcgccgacgggactgatgaaggagctgcattacggagaaggctaccagtacgcccaccagacagaggacaaaatcgccgccatgcagtgtatgcctgactccctgaaagaccggacgtattatgtccccacggaagaggggaatgagaaggcggcgaagaagcggctggaggaagtgaaggcatggagagaggcgcatgggatgtaagggcaggcagtaaagaattattttctgcggattgaagctgcggttgtggtaagctggctgagtgaaattactgattatttggtgatttcactcagcttttttaattcatttcctgcaaaaataatgcctgagagctgccagtacaaaatttaaaaaaaaaagatcgtttcattatagatactacaaacgactgacttataagcaggtgagcgtttaaaacgtctgattaattgaaaataggcgttataaacgctcggaaatacttttgtcgtgaattatgattattatcaggaggtattataatgaatgagcaatttatacgtagtcggctttccggattacgagaagaaaaacaggtctcagagcgaaagatgagcttggatttaggacacagtaccagctatattcgtagtatcacctctggcagaacgcttccgtcaatgagtgagttcctttatatatatgagtatcttggaattacgccaatggaattttttaatgatagaaataacacttcgctaatgcagcaaaaagcaattgattatatttattcaatgccggaaaaagatgtatggctgatgcttgaattcattgagagagtaaaagataaggatctatagcttaccgggcaggagggtatggaggattaccatatttctttgtaaaggggagaggaaatgatatgatttcaattgccatttgtgatgatgataatgatttccgattgttacttagggatgcagtttataaaatgatagagagtcatggagagcaagctgttattgaagacttttcagatggccagacatgcctttcacagcttgggagcagaaaatttaacattctctttctggatatagagatgccgggaatggacggcttttccatggccgggaaaatgcaaaagagttatccaaacatagtattgattttcgtctcttcccatgaaagcctggttttccagtcatatgaatacgatacattctggtttatgcgtaagagtgcgttgataaccgatttgaaaaaagcaattgataagtattttgcgcgtatcgtttataatgaattatattatgtggtaaatgcacaaaaagtctattataaagacattctgtatatcgaatgcaatgggcatttgattacaattaaaacagcagacagaacttatagcatgtgcggcagccttaaaaaattggaggaagaattaacgccctatcaatttattcgtgtacataagagttttttagtaaatatgaagcagatcaatgtgattcataatgataaaataatccttaccgataacagcagtgtattacttagcaaatctcggagagcagaagttagaaaactgtattttagaggaggcgcttaaacatggggtgatgatcgaactgattgcaaatgctgcgacatctataattgggattcattttattagccggtattgtcagccaaagtatgcggggagaaccagaatcctttacaaaatgtccggtgtccttgcttattttacaaccgtatcggttttgaattttcttatgccctttgagggggtactgggactggcatatcttctcgtaatgcttttgtatgcccgcatcgcctgtaaagggagtatagttgaacatgcccttggaaccatgatatgggcgtgcattattctcttctccacagtaccggtgtttgaagttacaactctcattacgaaccataatattaataatttattgatgtccaattattatctgaggacagagatgctgactgcagtaacaattctgaaattcatattatgcaatttcatgttaatgattaagaaaaacaaaggcctttttctgaataaaaatgaaggttacgttctcattggcttttgtttccttattctgtttctgacattaggtttttttacgatggaactgacctgggaaaatgaagtaatacgtcactttacgtctctatttctcctgtttggcacgatgcttatgattttgcttatttataacgtgtttaacagcttgagcagtcacaatttgaaggagatttcccggagctataccaataaggcgattggaatgcagggagaatacgtgaaggatattgaaaacttaaataagagattacagattcagagacatgatacccgggggcattacgttgctttacatatgtttttacagtctggcttgtatgaggaggctgcaagatatctggaagagctggaagacaatgagaagaagtataatgaattgccggatctgacggataatgatggactgaatgctatcttgtataagtcctgtttggactgtgaatcaatggggattacattaacctgcatcattcatgcggatgtaaagagaataaagaacagtgatatggggattctgatgtataatttgatgacaaatgcaatagaggccacttccatggcggataaaaaagaaattgatttggagattggaaactatcacggatatttgaaatgtaaaatgagcaacactgtacaggagtccgtacttaagaaaaatccaaagcttaaaacaagtaaaagggataaagaataccatggatttgggatggaaagcattcaccaggtaatagaaaaatacaacggtcactatgatcattgggaagccgacggaaaattcattcaggaattatatctggaatatccttcatgaagaagaaaaaaatgacagcaaagcaggtgagactgttgatctgtaagctttcggccatgctggctggtatgctggaacgagaaaagattattagagctgaagacagggctgtgtatgaatatggttttcaaataaccattgcaaatattacgaatgccttaatcgtattgttaattggtcttataacgcattcgattgtgagggttcttatattctatacagtttttcttagtatgcggatgttttgcggcggattccatgcaaaaacatatacccggtgtttctgtctgtttggtacaacctgcctgttatgtacggttgcgggctatggagttatggaatttactaatgtactgtcagctgcagtgatatctgcagttttgcagggactgtgtctgtatcagatggcgccggttgaaaatgagaatcatccactcagtaaagcggaaaaaaagaagtttcgaagttacagtatgattgtgtttgtattttgggttctgattatgttcttgatgtatacaaacaagtattacatgatcgcagcggttatctcagtcacgctgctatctgtatcaatactaatgttaatagcaaaacaaaagcggggaggtaaaacagatgggtatgaagaagaaaggttttgagatattagcaaagattgcgtcctatgctgcgaaacgagcagaaggaagagcatccgagtggggcggctaccagccaaaacgtccggtaagaaagtaaattaaatatgacaagggccagtgaagagagctgccgcacggatcaaattatcgtgtggcagctctctttttatatccgtaaacaggaatgaaatttcccaccggtattaataaaaatcccgtttatgcaatatttgtcccgtttatgcaagacgtattgaaatattttatgttcgtgttttaatagtagcaaagagacgtgattctagaagagaaggggggagcactatgagaaaaaactgaaatgataagtgttgtaaaatgttggcttaattttgtaccaatccgctcaataataaaatctttcaatgggaatgaaggggaaaagttatgaatcgaaaatacaaaagattatatagccagttcagccggcgctttttaagcttcctgctgatttttaccatggttgcaccggacatgatgcctatggtatcctacgcagccgagtatctgaataaccagccgcgatatgtcaattttgaacgtccggagaagctttccatagaggatttggagcttgccagtgattcagatgcaacaaaggaagagacaaaaacgcagaatgattctggggctgataactccaaagatataagtgaagtaaaaccagccactccatccaatgcggacttaagagaaccggagaatttctatgagccgcttgagattgaggaaccggagggcaggctcgttcagttcaacgacaatttccgtacctatgaggtaggggagcgcagctacgttaccgtgatgggaggatactccggcctttacaaggatgaagatgggaagatatcgcgtgtagacaacacactggtttcttccgaaacaaaaatacagatggaacggtctgccgcctatatactcgaaggagatgacccctccggtatggaggaggattctgcgctgttctatgaggaggaaagcgaagagatcccgtctgtctacaaaaatgcttccggcgcgattgatgtgaccatcccgtcaaaaccgacctcctccaggggcattaaggtggcgctggcctccagctctgatgcgattgagatgattccctctggcggcatttttaaaaagagtgctgcagcaggaaatgcgattcgctataataatgtctatcccggcatagatattcaatataccctgcgcggagatacggtaaaagaagatattattcttctggaacctacggatcagaatacattttcctacgaggtaaggacctccgggttaaaggccgcacagtccggaaagaatattatattttacaggacaagcaggaaatcgcctgtatttctcttagaggcgccttatatgatcgatgccgccggcgagacgagcaccgatttatctatgaagctgggacgtgggtcgaatggcagctacgagatatccgtcactgcagataaaaaatggctggatgcagaagagcggcagtatccggtacggattgatccggccaccgcagttccgtcaaatgagtttatctttgcaatggcatcacagggccagccgaatgccatatttaactgggatggaaatgcatatgttggctatgcagacagcaatttaaagaattgccgccaatacgttgcatttaatgaaaatgactgcgaaagcattacctctatgctgcaggatgcgaacgcggtctgcagcagtgcgatatttaccgtcacagccaggaccaacaacagcagcaatgcaaatgtatttaccgtcggtacgcccaccgtgggctgggatgcccataaaatcaactggaatggagctccgccctttacagagaccggaatcagacagtcagcgccgggcgagaacatggctatggactttgatattacagagaccatgaacagctggatcacagggaagacaccacaggccggatttgtcattaaggcagaacaggaacccggggctgatacgccgcaggaactgcgcgttcccggtgagattctgtataacagaaaagacgccatgggtccgaagatcaccgtggaatgggagggggacaaccctggaggcaatccggaagactacccggtagcagacacgactattaccgtgacgccatccgtcagaaaaaccgatatcgagggcggctctgccaccggtgtcctggctcatggaaaaactaccggtgatgctgaggtaacctgggaactgattgacacctcaaccggtgagaatgtgacaggcagcaaggccaccggcgaggataccgtcctgtatcccaaattcgatctggcgggtctggagcatgattttaccgtgatcccgaaatcaaactggcaaagcgacggcattgatttagaatcgcttaagacaaacacagtctaccagtttaaagcagaagctgaggcggagataaaggatgaatctggagaacctgccggagagacagaaaaatccggagagaagctctcggataccttcctgatctatcatgttcagcaggatgatctcgttcagcgaattgcgaggcattataaagtaaatcccaatacgattgcaaaggacaatcatatctacttaaatcagttgacagagatggatacgtatctttttatccgcaatcctgatcccgatgcgggagagtacaactttgagaatctgacgccatgggaagaactggtattatcagggctgctgcagggtgcgggcgtatactgctcctttggtttcgagcctgtcaacttaaataccggaaacttctatatgtcacagacagatgcgctgcttacagagcttggcggggattttgaagtacagagagcctacaactccttactgccggacaaccgttctgaatttggccgggggtggagcggctcctttggcgaacatttaaccatgcttccggatggaagaatattgtaccgccagaacgatggcgcgatgctgccatttaccagggaaggcgatatttacaaagggccggaggggtatgatctcgtattaaagcctctggattccttcgacgtagttcttccggaaattccaaaaccgccggtagcgactgcctctgaggcatcctacgcagcagagaaaccgatgctcctggcagacgatgaaacagcaaatgacgaaaatgagacagagcctggaacaccggaagaaccggaaaatccggaggattctgaaaattccgggaactcaaagcccagtgttgccggatgggaactcagctatctggatggctccagcatcctgtttgataatgcaggtttcctgcactataagaaggacagaaaaggaaataccacgacttatacctatgataatgattacagactgacagaggtaaggactgcgtcaggaaaaatctttgatgtggagatggatgaccacgaccggattacctccattacgctgccggatggggaggcagtttcttacgaatacgatgaagatggccggttgatttctgtgactgatccggaaggcggaatccgccgttatgagtatgacgatgagaaccgcatgaccgcgtggtatgatgagaatggaaacagggttattcagaatacgtatgatgatgagaaccgtgtaatcgcccaggtggatggcagtggaaatacggcagcgctggaatattttgacgaccacaccatcgccactgataataagggaaatggaacggtatactggttcgatgagcagaagcgtaccacaaagatcgtgtatccggatggttcttcgatagccagagaatatgatgcgtcgggccatcttgcttctgaaacggatgaactgggggttacgacctcctatgcctacgatgataatggaaacgttctgaccatcaccagagaagacggcagccaggcttcctacacctacaacgaacagaatcagccgctgactgccacggattacgaagggaatactacttcatttatctacgatgaacagggaaatctgctctctatgacagatgcggaagggaacactgtctcctggagctacgatgaagtaaaccgcatgatctccatgacagacggaaatggcggtaccagtacgtatacgtatgacggagccgtccctgtgagctataccgacggagagggaaatacgtataccttcacctatgatgagatgaaccgtcagctgacagccggcgacccgctgggcagctccgaggtatttgtctatgatcggaaaggccggcgtgtctcagagactgcgaaagatggtggaacgaccagttacgagttcgatcctgccggctgtgttctgtcgattacggacgccatgggtgtgaaaacagatttcacctatgaccggatgtataacattctgtccggtacggatgccatgggaaataccctgacctatgagtacgatgaaaactataacaaagtgagagaaaccgatgccaaaggcaatgtcacttcctacgcttatgacagccgcgaccgcctgatacaagtaaccgatgccctcggaaatgatatgacctacacattagacggcaaaggacatacaactgcagcaacagaccgtctgggaaatacggtaaaagcaggatatcacaagctccttggcgttcccgttacgatggaagatgctctgggaaataccgtgtattaccggtatgacaggaatggaaatgtgaagaagaccatctatccggacggaagtgaagtttcctacacgtatgaccgtgccggccatatcgtcagcacgaccgcacagaatggccttgtaacggcgatgtcctatgatggaaacggcaatatcattcggatcactgatgatgaaacccgcgtctatacatttgagtatgaccgcagcaatcgtctggtcagaagtgtggatccgctgggcggtgttacggaatatacgtatgatgcggccggaaaccagaccgggacaaccgatggcaacggccacaataccgaatacgcttatgacgcggccggaagactgaaggagatcaccgacgctctggggcagaccaccggcagcgattacgatttgaatggaaggttattaaagacaacagacgcgttgggaaacagcagtacataccattatgacgttcttggccagatgcgggccgtcaccgacgcggccggaagcgtgaccgccatggattacgattctctcggcaacgtcttaaagatgaccgatgcattaaagggtgagacctccatggagtacgacgcgttaagccgtaccgttaagatgactgacgccatgagcggggcatatgcctatgagtatgacgcggaaggcaatctgatcagcatgaccatgccggatggagacaaggtttccatggaatatgatgcaaagggccagatgagtgccagcaccgacgaggcaggggtggagaccacctatgaatacgattccatggggcggatagtaaaagcttctgataataccggaaataccatggtctacgaatatgaccttgccggaaatctgatcaaacagacggatacgatcggaagagctgcggtctatgaatatgacaagtttaaccgcctgatccgcgcgaccggaaccgacggggcggcgacagagtatgaatatgacgccctcgaccgcctgatccgtgtcactgaggccgatggaacggccacatcctacgaatacgacaaggtaggaaacgtgatcgggatcacagagccgggcgaagctgtctatacctacgcatacgacgccatcaaccggattaccggaaaggttgacccgctgggagcagcgactgcatttgcctacgatgcaaacggtaatctgacggaggctacagatggaaacggagtaaaaaacgcatattcgtatgatgtcctgaaccgcatgactgcactgcaggatggaaatggcaatagtaccggttatgagtacgatgaactgtcccgcctcctttccattacaacaccggagggaagtaagcaggagtaccgttacgatgcgttaagccgcatgacgaaggcaaaggatgccaatggactgattacggaataccagtatgatgtgatgggcaatctggtaaaggaaatatcgccgaagggggcggagaccagctatacctacgataagcacgacgaattaacgagtatcaccgacgccatggggaatgtaaccgcctatgaggtggacttaaaccgcatggtaacgaagatgacacagaaaaatggcggagagtatgcgtatacatatgacgccgtccaccgcctgactggaattacaacaccactgggactaaatcgccgctttacgtatgataatggtgacaatatcacaaaggatacagacagccttggccgtaccacggtctttgaatacgatattatgcaccggatgacgaaggcagtcaacgcaaagggcggagtggagacctacgagtatgacatacgcggtaatttaaatgcggtgacgaatgccatgggccataagaacacctacgtctatgacctgattgaccagatgaaggaaagcgtggatccggaaggaaaggcgacgaagtttacctatgacatggtaggaaatgtaacttctgtagcgaggccgggagaacgcaccaccagctacgcgtatgataacaactacaatataacggcgctgacagacccgaagggctatatttacaggaatacttacgataaggacaaccggcagattacggcagctgacccgctgaaccagactcagtctgttacctatgatgcgggaagcagaattacagccctgaccgataagatgggcttgagccaggagtttacgtatgataaccatggtaatgtgacggccgcgagggcgacggatggcctgatcacccatttccagtacgatattctggatcgtctgactatggttaccgacccgatgggaaatgacactctgtatgcgtacgacgtaatgggaaatatcacagcaatgactaatgctgagaagaatgtaacgaagtatgcgtatgacctggaaggcaacatgacctctttaaccagcccgatgggcaggaaagagcagttcgcttatgatgccggcggccggatgacagagcggatgacagcgaagggcgacacgatccgctacgattacgatgtcctgaacgggcttgtggaaaagacgtacgaagaccagaacggcgccgaagccgatcacccggtccagatgggctataatgtgatggggcagagaatctccatggaggacattaccggagaaagcagctatacgtacgatgcgctcggcagactgaagaccgctgtgaatggctccgggaagatcgtggaatatttctatgatgaagcggacaacctgcagaagatcctgtatccggatggatacgcggtaatctatacctacgacaagaatgataatatcacaaaaatcgtggatcgtgacggccgggagacattttacagctacgatcccttaaaccggcttacgagggtgaagagggcggatggaagcaccagcacttacacatacaatgcgagggaccagatcgtggaagcagagaatttatgttcctgcggcttcctgatttccgattatcagtacatgtataatgacgctggcctgattaccaatgagacggccaaagagtgcctgtttgcttcgaataaggatttcggccacaagggcggcccggatggagagtgcgtccatgtttctgataacccgtggcagaaccagaatccggagtggcagacgacaaagcggacattcaggtacgatgataacggccagctcatcgagtgcaaagaagataagggaatgttcgacaagactacctatacgtatgagtatgacagcgtcggaaaccggacaatggcaaagaagcagaaagcatttacgtatgcaaacccggataagacgacgtatacctacaatgcggataaccagatggtaagcgcggtggtctgcgaagggaatctgacgaaacgctacacgtacaaatacgatgccaatggaaatctgacccaggaatgcctgatgaattatgcggagacgacgtaccagtacgatacggagaaccggttaaaagcggtaaaggatgggcagaagcttctgatggcagccgcctatgacggagacgggaaccggacgttccagctgaattacaatccggaagcggaatgcggttacggaaagaatgtgagcggtgaaatcttcatgccggagaatcatgagaatgaagatggaagcttgacggcggaaggcgatttgttcagctatatctgttctgcaacgggaagagcctatgacctgacggaatatgtgaatgacacgaaccggcagtatacggaggtgctgaccgcttatacggtgaacagcggggcgacggagagctacagctataaaggaaggcagcggctgtcccggaataatatctggacggaagcgcgtgacctggtatgcaatgaaaccagctactatctgtatgacggaagaggcagcgtgacagccaatacctggtataacggtatggtgacaagcgtataccagtatgacccatacggccaggtgacgctgggaagtacagagcatacagacttctatgggtataatgcagagagctataatccgaataccggacttgagtatttaagggcgagatattataatactaataagggaagattcttccaggaagatacatatttgggagatattgctgatccgttgacgctgaaccggtatgcttatacgaagaacagcccgctgaattatattgatccgagtggaaatacgacttatggaggcggactaaagcaaagtactagtactgaaaaagattattttgctgctgtgaataaacttcaaaaaacatttgctgaccaccagcgtgaaaatagtctatttcctactacaaagttgaatttagctgatataggtatagatacaaataaatcaccatcaataaaatataatctgaagacgaaagcggcagtcaaagaaagcaaaaaagataaaaaaacatcgataagcagaacagtacccgcatctaattatttatatggaggtggggataatactatcaatgcctcaagttatgcagctgctcttcaaaatcaaaaggtacgtactaatactataatagaggagcaagcatataggaatgcgactggtagctatgtgaacagggcaactgataacgcagaagtaaagacaacagctacatcttgtgatgttacaaattcctacaaaaagtggggagatgaaaaacgtacaagcggtggacgatattcctatgatgcggctacagttgaaattgcatttggtgcaaactataaactgcctggaatttcaagagatgcaaagtatggtaaagacggattatccggtgaaaaggatataagatttttggatttaggagtatacggagaatataatacagtaagagctggtaacgattttctagtaggtagttctgaatttggcttagatggtagtctaggggtaaaggcattatcggcagaagggagagctgaaataaaagtagctcctgacggcgtatcagctgaagcaaaaggtcttgcatctgtcatttctggagattcatctattggttttgtattgttaggattatcatttggtggtacaatagagggacatgcaggtgcaattggaggtgaagcagcttttaagtttggcggcgatggagtaaaagtaaaagcaggtgcagcagcactactgggagtatctgttggtcttgagattaaaaaagtagatccttaagcttgcgggaggaattcttctcctgcaagcaaatagatatggagtcataggaggaaaatgagacaaatcaggttattttttcttttcataagcgtagcaatattattaacggcttgtaaaaataatgagataggagaacaaaaggtggatagtaaaaatttggaatattattctcaaagtgaagtttttttgcctcttggttctgttgtacaggtggaagatggaactatatttatgatttctggatattgtaaaagtattacaaataaagaggagggtcatgtgtttgattatcaaggagtatactatcctgagggtgatttaagcgatggtcaggtttatttgtttgataaggctgatattgtagaaataaaatttgttggatacgaaaccgatgaatcaaaagactttgcaaaaaagttaataagcgagtttcgcaggtgaatttatggatcaaaggataagtaaaacaatgataactatatttgtaatatgttttatattttttttcataacaattttcggcggattgttttatatgttggatggtgtagaaaaagccgaaaattataaattatcgggtgatgagatatctacttttaccaaggtaactggatatggtaaaattaggaagatgcattctcaatctactcctgacatggtgcaaaagacatatgtatatgcaaaagtacccgattattcacaaaatataactacatatcaacaatatttaaaagactatgaaggatttatggagatgagcaccggggcattaaaaatgtctggaagttcggcgattttggttaaagaatcaaaggatcaaggtaagttgcttacagtgcaggtaatatatgctccaggaggagttgagataacattgcaaaaaatatctggagaattaacagaaaactagaaaggatttgtgcaaattaataaaagataggggatatctatgagtgcttatgttgaatgatttgcatataacacaatatgggtaaagacttattctcaaataatcctgatgagcaatgtaattcaattttcttaaattcattttgctattaaagtatatggtaaggaaatagtattgacatactttttagcagcatataatagttcttgtgtaattgtgaaatattttgtattcaaatagtataaatggatgttgatattaaagtagtaacaattacaacattggcgcaattagccttaaacaatataaattattagagttttaaaggtgaatataaaaaataggtgataatgaaaaaaaaatttgtgcttaaagcatcagctaatattgaaaaaaagtagtctgttataaatagatagttctggaaggcaagacaaagaactattttttactcaataattagtatataatggacggtcaaagctattgaatatctgttaatatcctttcgtaactaattaagaatatccccataagaatgtacgaagcttctattcttatggggatattactacgattacgatagaataaagaatctgtttgataagacaacctattttatagcgtatgatagtgtcagaaaacatacgatggcaaaacagcaggaagctacagctataatggaagacagaggctgtctcgaaataatatctggacggaagcgcgtgacctggtatgcaatgaaaccagctactatctgtatgacggaagaggcagcgtgacagccaatacctggtataacggtatggtgacaagcgtatacaagtatgacccatacggccaggtgacgctgggaagtacagagcatacagacttctataggtataatgcagagagctttaatccgaataccggacttgagtatttgcgggcgaggtattataatgcagataagggaagattcttccaggaagatacgtatctgggggatatcacagacccgctgacgctgaaccggtatgcttatacgaagaacagtccgctgaattatgttgatccgagtggacataaaatttcatcattaggtgacttcgtttcatttgttcaaaacaaagctaccgagtttagggataaagcgagtagctatatttatgaaaaagccactggtgcgctgaaggggatgtcggaatgggcaaaagagagctgcgagacccttgattgtgaactggttacagtcgcgtataatattctgctgggagcaggatttgcgctggttgaaaacgcgctgaatataatattctcaatgaaagaacttggcagtcaatgggattccagtgacagtgattattaccagaagttaatggaggactgggtattagaaaacggtgttactgatacaacatatttttatcttggtcagttagttagtgatgcactgcagacatactttgcagtaaaggcgattcctaaacttcttacaaaaataggtccggcactgacaaaattagcaggcatattaggcggaggatccggtggcggaatggttccagcattggtaggagtaggagaatatgccagccaaattggaatgtctgccgaaatagcggaaacgcttgttaatgaatttggagcagcagtagctggggtgttgatagtatttgcagatataaccggaatagggcatgatgcggggaagtttgttgaagcgctgacaaagggggattctgagactaagttcaaaactggtgatttgtatgaggattctatagatgttgacggacatagaatagatgcattggcagaggtggaagtggagggagacagattaattttgaaggatttagcaatttattcgaatgaaggagatattccaaatcaaatcggtgctagtgaatttaaaacttggttaaatactgtaaaggagcaagcaaaaaatcaaggatttaaggaattacagataattgctcaaagagcagaacattctacatcagctaatccagggcatgtaataaataaaattatacagcttaagtgaggtaagtatgaaaatagtaatggatgaacagcagtatcaagaattagaggatttaattggcatctttgatggaatgttttttgatgatgaagaggtgcaatgctttaaatttattaaagatattgtagatagggaatttgatacagattatattaataaagagagaaaagaacttatgggaaagcagttgaatgagtcatttgaatggttagagagtttaaatgtaaatataaaaaataaggataaatttctatcttgttttttgtattaatagtaaagattcgcccggctttgccgggcgatgtcctccggtttgggtggcgtcaagccacccagcctttaaccagcacacttttcgaccctgcgaatttttcggattttggaataatatctccattttacatcgggccaatgagccgatatactcggttcatggtacatctttccgagtccggtaggaaaagggcaacacgggcggtcacagcgcggcacatgggcaagaaaaccgctagtcagaggcatctcactgaaagtagtacttttggcgagattactgctattaggtggacatacttcttcgccacccaataatcctttgattttgcggtatttcgaggcgttctgggtggcaaaattctggaaatgagaaaagctgggtgccaccaagccacccagcagattatttttcgacctttgaaatgaataccgaaagtaaggaaccagtaagaaaaacgcaaggaaaaggaaattgacctgcgggctggttcatggtaaaatggcgcacaccagggggtataagggggagaaaagtgactgattgtaactaccagaaaatcacaataatgagtcagcggtcataggatatggctgttggctcattttcttttctggcgataccactatgacacaaatcagtccaccatttttgtatcacatttcacaaacattcagaactgctcccaaataacttgcggatgttcctattcagagttaacatacgacaactccgacaggagaataacctgtgaaatccaaggttagggaagcagacaggcttaatcccccttgcgatggccgttgccgtagggcgtaattcggcacataacgcttatcagctgaggttgccggtgattttgtaattgtggatggagacaggacaaaaaggaaggattgacacgagaaaagaaaacatcatctatgtagggattgatctgcataaggaaacacacacggcggttatgcttgactgctggaatcagaaactaggtgaaatcacctttgagaacaaaccatcagaattccataaactgacgagaaaagtcagtcggtttgtgacggaagagaagacagcggtatatggattggagaatgcctacggctatggccgtgcgctggcggtttggcttttagagaaaggctacactgtgaaagacgtgaatacagcattgtcctacgcccagagaaaaagcgttccgatgtatcagaaaaatgacagttatgacgcagaagcggttgcacttgtgctgattaatatgttggacaaactgcccaatgccgtaccggatgatgcttactggactttgagccagttggtgaatcgtcgggataacatctgttcccatcagcagagattaaagaaccagcttcatgaacagctctgcgtggcttatcccagttataaacagttcttcggggacatcagccgggcaacagccttatatttctggctgaactatccatcgccggaacatctgtttggaaagacagctgaggaactggcggcagaactgcgcccaatcagccacaataactgttcaatcaagcgggcagagaagatactggaactggtgcgtaccgacggtcagaccatcagggaacaccaggagagccgggatgccatcacgcgcagcattgcaggagacttggaacattaccgggaacagcttgagattgtggagacagcaatagtaaatatgctgccatcatttaactgtaccctgatgacaatgcccggagtggacgtaacaacagctgcgaatatgctgtcagagataggagatatcaaccgctttcctaacgccaataagctggcaaagttcgcaggaatatgcccaatcaacttttcgtcagcgggaaaaggaaaggatatgtgcccgaagcagggaaacaggcggctacaggcaattttttactttctggcaattcagatgattcagatttccacgaatggaacgccgaggaataaggtgtttcgggagtattacttgaagagagtggcagaagggaagaataaacagcaggcgttgatctgcattgccaggcgtttggtgaatatcgtgtacggaatgttaaagaaccacacagaataccgggaaccggagcaataatggttgtcggttacgaacactttatgctaagatgaaaacaacagaaatacagtaaatggtttaccgccttttcccaaagaacagagaaaaaggcgtaaaagttatgaggactcagcgtcagtgccaagggggattctgagactgtaacgtctaataaaggaaatgtttatgacaatactccatcgagtaatcattctacaacaagcggcaatcctattaaaggagaaccgaattcatctgtagatatattggataagaatggaaatgtcgtgagaagaagatggtttgattcggagggtaatgctatgcgagatatagactatacaaaccatggcaatcctaaaacgcatcctgaatggccacatgaacacgtttgggagaatgggagatctccttatggtgggtgaggcattaagagaaagaggtaattatatggtgtggaaaagagtaagatcacaagaggatgttgattgcatgaatgaaacatttggagaatttcatgattgttgtctaaaagaggtgagtttttcaacaggaggttatgtttccgaagacttgtctatgaacgttattggttttcctacagcaaggtttttgtttcagcgacagatgagaaatccatcagtaattgaaatagaatttagggacataatacaaatcaacataaaacctgttgaaaaaaatcaaggtgttgatataattggtgcacacctttatttacaagatgatatttttttctggagtgaaaaggattacgagtttcatgacggtaataaggatacgtatacatggatagcggctcggtttactcaatggagagaaagggatgatttattagggagtcaaatggtatatatgccagattagttcattggtggttgtatctaagaattcctaactcattaattaactgttgactgtattaataatctattcgcccggctttgccgggcgatgtgttccggttatgtgatgtcaagccacccggcctttaacctgcacacatttcgaccctgttaatttactgtgttttaaacgaaatctatggttttttatattgccccaacaagcccccaaagccttgtataggtatatctttgcagagggcggtttaaaatggcacacgggcggccacggtgcgtcacaggggtaagagaaaacgctggcagactgttggtcggataagatttttatgccgccgtagattctttgtgcagattcttgataaatccttggaaaacggttaatttcttatttgccacccacaaaccccttgattttgtgagaaatttgcttctgtgggtgcccaaaagctcaaaatcagaaaagctgggtgccgtcaagccacctgcgagactgccgttttttctctggagtttaaatgctggtaaggttacagtaagaaaaatacaaggaaatagaaattgaccgcaggggcagttccgtggtaaaatggcgcacaccgggggtcatagaggggagagaatccgcacagattccctgatacaagaacagcacatattttgtgcagcagaataaggagagccgccgagtcccataacaggactctgacggctctccttttgcgaaaaggtcacaaactgttgataagcttcagcacccggattccatcgataaagcctgcggaatacaagcaggttccttcgtcagccaggcggtcagtcatgccattcatatacctgtctaaaataacccactcttcatgcgacagctttctcatgatggcttctgcctggctgatcagctgtgatacggcttctgttttttccgtatgtttcatctgtctcaaaagtgtatcaatccgttcgctgattatcatatccagcaattctttttcgtcctcattcatagggcgcacctccttctattccaaaggatatcggaataccttttggaagtcgataccactatgtgacaaataggctcgctgattttgtatcacctttcacgaacttttagaacggcttcggaatgacttgcctccgctctttttcagaggtaacatacaacaaccttgaaaaaggaataacctgtgaaatccgtaggttatgggagcggataggcttaccctcccttgcgatggccgttgccaaaaggcgtaattcggcacataacgcttatcagctgaggttaccggtgattttgtaattgcggatgaagacaggatgaaaaggaaggattcagacgagaaaagaaaatatcatctatgtggggattgacctgcataaggaaacacacacggcggtcatgcttgactgctggaatcagaaattgggtgagatcacctttgagaacaaaccgtcagagtttcataggctgacgaagaaagtcagccgctttttaacagaagaaaagacagcggtatacggattagagaatgcttatggctatggccgcgcgctggcggtttggctactggaaaaaggctgtatggtgaaagatgtgaatacagcgttgtcctatgcccagagaaaaagcgttccaatgtaccagaaaagtgacagctacgacgcggaagcggtggtacttgtgctaatcaatatgctggacaaactgcccgatgccgtgccggacgatacttactggacattaagccagttggtaaaccgtcgggacaacatctgctcccatcagcagagattaaagaaccaactgcatgaacagctctgtgtggtttatcccagctataaagggttctttggagatatcggccgggcgatagccttgtatttctggcttaagtacccatcgccggaacatctgtggggaaagaccgcagaggacttggcggcagaactgcgcccaatcagccataataactgctctatcaaacgggcggagaagatattggaactggtacgcacagacggtcagactacgagggaacaaccaagcgagccgggctaccatcacgcgcagcattgctggtgacctggaacattaccgggaacagctggagattgtggagacggcgatagaaaatatgcttccgttctttaactgcaccttgatgaccatgcctgggggtgatgtgaccacagcagcgaatatgctgtcagagataggagacatcaaccgatttcccaatgccaataaactggcgaaattcgccgggatatgcccaatcaacttttcatcagcaggaaaaggaaaagatatgtgcccgaagcaggggaatcggagactacaggcgattttttactttatggcaatccagatgattcagatttccacaaacggaacgccgagaaataagatattccgggagtattatttgaagagagtggcagaagggaagaataaacagcaggcgttgatctgtatcgcccgtagactggtgaatatcgtgtacggaatgctgaaaaatcacacagaataccgggaaccggagcaataatggttgtcggttacgaacagtttgtgctaagatgaaagaaacgaaaaacacagcgattggtttcccgtctttcccaaaagaacagagaaaaaggcgcaaaagttatgaagactcagcgtcagtgccaagggggattctaagactaaggaaccaccttcagcagatgaattagctgaattagcaaagaactctgaggaaattgatggactatccggaacaaatgtagatgtgaatacagtaatggaagcaggtcagaaatttgtcggaaaaggatataaaacgacaatggaaaatggtatgattaaatacacgagtaaagatggtacaaagtctttcagaattatgactaaaaaaacgaagggggtttacgaggcaaactttgaaatgtttgattcagcgggaaataaattaacgaattatcatgtgggcattattgaagactgatatttttccaggaggtttagatggttataccaattttagattgtattttagatgttgaggaaccagaggatatagaagactttgttatgcatttagaagcatgtataaatactgaaggtgataaaggtgcagattgcttttcttttagaataatgactccgaagcgattagagaaattatccaaggggataggggcaatgttaataagatcagtatttattgttaagggttctaatatggaggaaaatataaattatattacagaagaaataaaaaagttactggaaggatgcgcaagagaatcgtgggaagaaactgcattggcaattaactattatttaaattgggagtattatgatccccaaaagggaatatgcgatttttacaagaatactcggaatctaacataaatagtatttggcccggctttgccgggcaatatcccacggctgggtggcgtcaaagccacccagcctttaaccagcacacatttcgatcctgctattttagtaaatttcaactagaaaacccgtttccgaatcggcccaacaaggcgtaatacctgtttgatggtacattttactaataaacgaaacagcatgacaaaaacggccataaaataatttttatcggccgtttctgtcatagagccatatacaaatgcaggttcaggctctactccccatccctttcgtcattcccatctttcccctgatcaaccatcggcccatctgtgccttccggtgccgttgcccctttcgtttgggcgtcatccgtctgctctaattcctcccgggatttccggagctgttctccctgacgaagcgccagctccgatgctttgtcatgcagctgtccggcttcctgctcggaacgtccgatggagtccatctcattttctatgagggcgcctaccgtgtcgccgccgagtcccttgctcactaaggcgtcgacgtgaaccgctccaagatcaatttccgattctttaattctggcttcgccctctatgtggctctgaactgcggaaatcttttccgcatggcggagatcctgggagacagcggccagagttgtaagatgttcggtcgtcagctgatcgtcggttttactcttgtctgttttgtcagaactctttttgtcttccggctctatgcactgtttggcctgctgggtgtaggcgttagaaatctgtttatcaatggcttcgatctgcttcttgtacgatttgagctgatccttgatgtcctccatctttccgccgtcgcctaaggtcgtttccaccagactgtttctttgatccacaagcgcctgtttctgcttggtcagattctcaatcatgtttattaatttaccctgaggggagagggtgaaacggtcgtttttcggacggtttcccagtatgcccccgcttttcttatcctgccctgactggtatttggcgaatgatgcatttacccgtgcggtattgataagcgtattcttatgcaggttgaaattcagatttactctcattccatttcctccgatctttgatgtccgttactatccttatcgtacaggcggtgaaaatgtttagctttttcaaaaaaaactttctgtattcgttttctgctgtgaactgcagcccggtgtgtttttggatttcaggagatctggaaaaaatgttgatttttcaacctggttgtaatataattaacttttagcctggaagtattttgaaattagtgaaatgggaatgcataggaaaaagagaaacaggaagaatattcaaaaaggagaacaggaaccgatgaaaaagattcttgatttaatcacatcagaggtaaaagaggcattcgcagcctgtggttacgatgagagctttgcgaaggttacactgtccaaccggccggacctctgtgagtaccagtgtaatggtgccatggcagccgcgaaggcatataagaagaaaccgatcgacattgcgaacgaagttgtggagaagctggctggcggcgatatgttttcagaagtaaacgccgtgatgccgggtttcattaatataaaactggaagccggatatctggcaacctacatgaacaacatgagagagggagaccactgcggctgtgaaaaggcaaaaacgcctctcacgatcattgtggattacggcggagccaatgtggcaaagccgctgcacgtgggccatctccgttctgctgtgatcggggagagcattaagcggatgggacgtttcctgggacataaggtgatcggcgacgttcatctgggagactggggacttcagatgggcctgatcattgaggaactccgcgacagaaagccggagcttgcctattttgacgagtcctataccggagagtatccgaaggaggcgccgtttaccatcggtgagctggaagagatctacccggcggccagcgcaaagtctaagacagacgaggaattcagcgcgcgagcccacgaggcgacactgaagctgcagaacggatacgcaccttaccgcgcgatctggaatcatattatcgatgtttccgtaacggatttaaagaagaattacggtaacttaaatgtaaccttcgatttatggaagggagagagcgacgcgcaggactatattccgggtctgattaaggagctggaagacaggaagctggcgtatgagagccagggagcgctggtggtcgatatcgccgagcctggcgattccaaggaacttccgccctgcatcatccgcaaatccgacggcgcggccctctattctacctcagatctgggaaccattctggagcgtgagaaggaatactgcccggactggtatatttatataacagacaagcgtcaggagcttcattttacccaggtgttccgcgtggccaagaaggccggattcgtaccggaagagcgtaagatgtcccatttaggcttcggcaccatgaatggaaaggacggcaagccgtttaagacaagagacggcggcgtgatgcgtctggagaccctgatttccgatattgacacagcggcatatgataagatcatggagaaccgctccgtgtccgaggaagaggcgttaaagacctcgaagatcgtcggtatggcggctctcaagtacggcgacttatcgaatcaggcttccaaggactacattttcgatatggaccgtttcgtctcctttgagggaaacacaggtccctatatcctgtatacgattgtgcgtatcaagtccatccttgctaaggcttccgagctggaagtgcagagcgtgtgcacgggagatatccttccggccgcctccggtgtggaaaaagatttgatgcttcagctttcgaaatataatgaggtgatcgagaccagttttctggaactggctccccataagatctgccagtacgtatatgaactggctaacgcgttcaaccggttctatcacgacacgaagatcattgccgaggaaaacgaaaaacagcgtgcttcctggctcagtctgatcagtctggcgaaggatgtacttaccgcctgtatcgatctgcttggaattgaggctccggaacgtatgtaatgtgtgaacggatgtgaaaaacttatgaaagtatcacagatgacaacaagcgccttctggaaaggcgaatcgggcgtaaaaggcctggttgaagaccagggaaaacagtataaagctaatttatatatcaagggtagtcaggtttatgactactcttgttcctgtgtgcagggaaattcctataaggggatgtgtccgcactgtcaggagctctacagggagtaccgggaaaaggcggctgagaattcgggacggcccgtcaccacctcccagcaggccagaaccatgatccgggagtacaccaaccgggaagtggctcagatcattattgagggagaagaaaagcaggtgcagctggctgtccgtatcattgcggaccggagcgatgtgaagctggaattccgtctggggcgggaacgtttctatgtgctcaaggatcttgtggcgtttacgagagcggtagagagcggttcgctggtggaatatgggaagaacctggccttccaccacaatctgtccgtctttgcaaaggagagcaggccgctggtggaattcatcatggagctggtcaacacttactgtgagcactatgaacagtttcagaagagctctttttcgaacctgccgactctgcggggcttaaatttgagccggggcaaccgggaccgcttcttcagcctgatgatgggcgagacgctggaactggaggactaccgtgcccacaagagaatggtgacggtgacggatcataatcccgatctggcggtcaaagtcagaaggaagggacgggatggcatcctggtatccatcgacaaggggcttctgatctttgagggggagcgccatctctatgtggtggacaaggaacggatctttcgctgtgacgaagcatgcagtgccacactgcacgtcttcctggagcagatgataaagagcttcggctccaactgtgaggcggaagtgaatgacaaggatatgccgcttttctatgagcgcgtgctgaaaaagatcgctgcgtacagtacgatcgacgcaggcgacgtggaactggaggcatacaagccggaggaactgaaagcgagattcgagttcgacagccagggaccgaacgacctggtcttaaagccggttctgtcttatggggaatactcgtttcagccggtggaggatgagaagctccccagaaccgtttgccgggatgtgccgggagaattccgggtcagccagctgattacaaagtactttaaatacaaggaacacgataccgaatatccggcgatccgcgacgacgaggaggccatctaccgccttttaacggagggcatgagcgagttcatggctcagggtgaggtatatttgtcggagtcctttaaaaaactgaaggttcttccgcctccgaagatttccatcggtgtgaagagcagcggcagctggctggagctgacggtggacacggacggaatgtcgggggccgagctcacgaggctgctctcggagtacagccagaaaaaacggtactaccgcatgaaaaacggcgagtttctggctctggacgataacggcctgatgacggtggcgaagctggtggagggcctcgcagtcaacaagtcggatttacagagtcagaaaatccgtcttcccaaataccgggcgctctatctggatggtattttaaaagagggcacaggcatcacgctttaccgcgatgcgctgtttaaggctgtggtccgcggcatgaaatccgtggaagacagtgattttgagataccgctgacgctccgtcccgtgctgagagaataccagaaaacgggcttccggtggcttaagaccctggattcctacgggtttggcggaattctggcggatgatatgggccttggaaagacgattcaggttatcgcgctcctcctggatgagaggaaccgcgagccggacacgtccgcgctgatcgtctgcccggcgtccctggtgtacaactgggaaaatgagattcatcagttcgcaccgaccctgaaagtccgtacaataaacggtactgcacaggagcgggaagaacttctgaatgcggcctcggagggggagatcttagttacctcctacgatttgctgaagagggatatcgccttttacgaggaaaaggaattccgttttcagatcatcgacgaggcgcagtatatcaagaacgcctcgacccagagcgcgaaggcggttaaatcggtgaatgccagaacgagattcgccctgacgggaacgccgattgaaaaccggctcagcgagctgtggagtatatttgacttcctcatgcccggcttcctgttttcctatcagagattcaagaaggagtatgagcttcccatcgtgcgggatcaggatgaagcctgtctaaaggggctgcaccgtatgatcggtccgtttatcatgcgccgcttaaagaaggatgtgctgaaggaacttcccgataagctggagaatgttatctattccggcttcgagaaggaacagaaggatttgtacaccgccaatgcatggcaggtcagacagcagctggagcaggccggagacggcggctccgacaggattcagatcctggctcagctgacgaagctgcgccagatctgctgcgatccgcatctctgctacagcaactataacggcagctccgccaaactcgagacgtgtatcgatctgatccggaacggcgtggagggcggccataagattctgctcttttcccagtttacatcgatgctggaaatcatcgaaaagcggctgaaaaaagaggggatggcatattatattctgacgggtgcgacacccaaggaagagcgccttcacatggtcaactcctttaaggacgacggtgtgccggtattcctgatctccctgaaagccggaggaacgggattaaacctaacggccgcggacgtggtcatccattacgatccatggtggaacgtggcggcgcagaatcaggcgacggaccgcacccaccggatcggccaggaaaagcaggtaaccgtgtttaagctgatcacgaagggaaccattgaagaaaatatcttaaagcttcaggaatcaaagaagaatctggcggaacagatcataacagaaggcaccgtctcgttaggcagcctgacgaaggatgatctcatcggcctgctagtgccttccggcgcaaatacgctgggggcactagattagggtgtgccggaaaaatgctttctgtcacaccctggccgggatgcttattttcagttcacaaagaaaggatggattaagatgaaagtactgctgttaaacggaagccctcacgaaaagggctgtacataccgtgctctcacggaagtggcgggagctcttacgaaagagggaatcgaggcggagatcgtccatatcggcaatcaggccgttcatggatgtatcggatgcggcaaatgcgccgcgacgggccgctgtgtcttcaagggagatccggtcaatgcatttttggataagatggagcacgcggatggactgatcgtcggatctccggtctactatgcgtcggctaacggctccctctattccttcctggaccgtctgttctacgcgggaagctgttttgcgttcaagccggctgctgcggtggcctctgcacggcgcgcgggaacgacggctacgctcgataccctgaacaaatactttacgatttcccagatgccggtcgtatcgtcccagtactggaacatggttcacggcaattcgccggaggacgtggagcaggatttggaggggctgcagatcatgcgcacgttggggaagaatatggcgtggatgcttcgctgcatcgaggcgggtaaggcggcaggaatcacgacgccggaagcggagcagaagcttaagacaaactttatccgttaaaactggaggctatgccggagaaccggcgggcggcggaaggagcaatcctttcaccgcccgctggttcttcggctgtgtactgactccgctgagaaaaaaattaatgtcccggaaacggcctgcggagagcgctgatgtgttttttcagggctttagaaagaaagaaaaagagaaaaaggcctttacttttgccatatctgttgtataatggaaaagcactatatatggtgaagaaataattacatacgcaaaatgtagaagatttcacggcaaattgacagctgctgtgttattttttagcagtattataaagtagaatatggattaaaggaaataaggagacagcgatgattaaggtacagaaacgtgacggcagaattgtaaattatgacagagagaagattgtaagggctattcagaaggcgaatgcggaagtggacgcggcggaacgcgccggggaggcattgattgacggaattctggatgatgtggagaaagattgtgaggatgttgtccatgtcgagagcattcaggatatgattgagagccgcctggttaagcagaacaagtacactctctcgaaaaaatatatgatttaccggtatcagagggcgcttctgagaaaagcgaacacgacggatgaatcgatcctgaagctgatccggaatgaaaacaaggagctggcggaggaaaattccaataagaatacgattctggcatccacacagagggattacatcgccggagaggtatccagggatttgacgaagcgtatgcttctgccggaacgtatttccatggcccatgaacagggagcgattcatttccatgacgcggattactttgttcagccgatctttaactgctgtctcatcaatatcgcggacatgctggataacggcactgtgatgaacgagaagatgatcgagagccctaagagctttcaggtagcctgtacggttatgacccagatcatcgcggcggtggccagcaaccagtatggcggccagtccgtggatatgagacatcttggaaagtatttaaggaagagcagcaataaattccacagacagatccgggaagagtttggcgacagcctggataacgaggcggtggagaagatggcgcggattcgtctgagagatgaactgaaatcaggcgttcagacgatccagtatcagatcaacaccctgatgacgaccaacggccaggcgccgtttgtgacgctgttccttcgcctggacgacgaggatgagtacatcgatgagaacgcgctgatcgtggaagagattctgcgccagagactggaagggatcaagaatgaggcgggcgtctatgtgacaccggcatttccaaagctcatctacgttctggacgagaataactgcttaaagggcggaaaatacgattacatcacgaagcttgcggtgcgctgctcttcaaagcgcatgtatcccgattatatttccgcgaagaagatgaaggaaaactatgagggcaatgtgttcagctgtatgggctgccgcagcttcttatcgacctggaaggatgagaacggggaatataagtttgaaggccgtttcaatcagggcgttgtgagcctgaaccttccgcagatcggaatcctggcaaagggcgacgaggaggtattctggaagctattagacgaacgtcttgccatctgcttcgaggctcttatgtgcaggcataaggcactggaaggcacattatccgatgtgagcccgattcactggcagtacggagcgatcgccagactcccgaagggggcgaagatcgatccgctgcttcatgacggatactccacgatctctttaggatacatcggtatctacgagatgacgaagctgatgaaaggagtcagccacacggacccggcgggagaggagtttgccctccgcgttatgaaccgcatgaaagaggcagttgagtgctggaaagaggagaccggtcttggattcggcctttacggaactccggctgagtccctctgctaccgttttgccaaaatcgacagagagcgtttcggcctgatcgaaaatgtgacggacaaaggctactatacgaattcctaccacgtggacgtgagagagaagatcgacgcgttcagcaagtttacatttgagagccagttccagaagatttcttccggcggcgccatctcttatgtggaggttccgaacatggcgaagaatctggaggccatggaagacgtggtcaaatacatctatgacaatatccagtacgcggagttcaataccaaatccgactactgccaggaatgcggcttcgacggtgagatcatcatcaatgaggacatggagtgggaatgcccgcagtgtcataataaggacaaggataagatgaacgtgaccagaagaacctgcggttacctgggcgagaatttctggaatgccggaaagacaaaggaaatcaaggccagagtgcttcatctgtagtctgaggagcgataatatcatgaaatacgccgatatcaaacattgcgacgttgccaacggcaccggagtgcggacgagcctttttgtgtccggctgcactcaccggtgccggggctgttttaatgagatcgcatgggattttaattatggaaatgagttcacggacgaggcggtacaggagatcctcgattcctgtggaaaaagctatatatccggtctgtccctgctgggcggagagccgatggagccggagaaccagcgggcgcttctgcctctggttctccggtttaaggagctgtatccggagaagacaatctggtgctacaccggttatacgtatgagacggatctattggcgccggagggacgggcacactgcgaggtgacgcccgaatttcttgcgtgcatcgatatcctggtggatggcgaattcgaccaggagctttacgatctcaaactgaaattccggggcagcagcaatcagcgcgtgctgcagattcacgagccgggctgcccggagctgtttgtggaaaaggataggtaaagggggaatacggccgatgaaacgggagatcagcctggaagagatatcagatgggaaactgtatggcagcggcgacatggtgaaggtgggctgtgacgactgccgtggctgttccgcctgctgccgtggcatgggaagttccattgttttagatccctatgacgtctttcggctggagacgggccttggcctgtcctttgaggggctgctggcggaggcagtggagctgaatctggtggatggcataattctgccaaacctgaagatgtccggagagggggaggcctgcacctttttaaacgaggaggggcgctgccgtattcatcccttcagaccgggaatctgccggatgtttccgcttggacgaatctatgaggaccacggcttccggtattttaaccagattcacgaatgccggaaagagcagaagacgaaggtcaagatccgcaagtggatggatactccggatatgggccgttatgagagctatattgtggagtggcattacttccttaaggagctggaagaaaggctggagcagaaaccggagcagaaacaggaagagggatcagaaccgaccggtggggaagatgcgaggaagcggactgctatgggggtgcttaagcttttctatctgattccgtttcagaaggagttggatttctatcagcagtttgaggcgcgcatggcggctgcgcgggaggaatttattaattttctgtaaaaatacttaaggttcccaaatccctgtttgcctgccggcggtctctgtgatatacttatagcaatggaatcggcaaggcataaacaggtgtaaagtatcaggacggttgtccgaaggggaggaatacctttatggcgaaggtaaagaggtttagcacaaaaattaacagttttttcgtggagtggagtgcgctgaatcattatttgtcatcctatgaatgtgagaaaaacggcgttccctacatcggttttaaggacccgagggttcagaaactctggaacagcttaagttccgcggaaaagcgggatctgatgaagcattatgggaagaagaatgaggcggagctgggcgactatctgggatgaggggcatgaatcatgattctttcgggaaaagaaatattaaagcacatggggaaagagatcatcattactccatttgatgaaaagagaattaatcctaacagctataacctgtctctggcggatgaacttctggtttacgagcaggatgagctggatatgaaaaagcccaatccgactaagcagatcgtgattccggaggaagggcttcttctggaaccaaacaggctgtatctgggaaggaccaacgagtttacgaagacggatcggtacgtccccatgctggagggccgttcttccacgggcaggctgggactctttatccatgtgaccgcgggctttggagatatcggcttcgccgggtactggacgctggagattttctgtgtgcagccggtcagaatatatccgaatgtggagatctgccagatctattaccacgatattgatggggaatacgatctctacagcagtggaaagtatcagaataacagcgggattcaggccagtctcatgtataaggactttgagtgagagcggccttctgataagagaacggtataagagatgatgtaagagattatataagaaaaccggataataaaaagaggaagatgcagagtcaggagtccctgaagctgtatcttccttttttatggtcacaaccgcttattccctatgccccgccgcgtattccccgggacagatgtccatgaccacccggactggctggattaaggcgtcctcgtactggcatctccactgtacctcccggctcatccggccgtctgcgattccgtcgatggtctcgccggacttgaccggcgcgtcggccgcgtagagataggaggccacattgtatgcatggtttacgacggcctgcggctccagaccccggaaatggtactggacgtcagggagtccaattgcatagagccccagggtatccacaaccttgtcgtcgctgccggagatgttgaaaaggcgggcgttgacgccaaagtatatgaaacggtcttcacgcggtattttgtgttccctgatctgatctgcggtaaacagtttcccggccggcttgatccagaccgcagtgcagtcaggaaacagtctgaccgctgtctccatccagtccatcatcatctcacagcgctccttgtattccaacacggcagccatcatgtcaaaaagaaaaatctcataccggcaccgctccaaaagagcgtctccgtcggccacatcccagagctggctccgggaaaatgcgtcaatggagtcctgcttgaattcctgaacgtcccccatgacgacctggggcggcagggcgccgtctttaaactgtgccagatatttttttacggcaaaagaggtcagagccggtgatggggacacgatgtcgatcgcgccgaaggtttcttccagagccgtgtgtatgatcccggcctccggcttgaccggtttttcttcaaacagaaggtagatctgataaaggttctgaaattctgctttttcctcaagattctgcttcagctcttctttcggttctcttttctttttaaataatcccatatgcgttctcctttgtatctgtcggcaggaggcggattcctccgccgttacctccagtataccgtattttgaaaaaaaggccattacgatttgcttaagatttcccccaggctttctgaaaaccggagaaaggaaatggggcagacagtgggatttcgtaacggcggcagatacgcacaatctcatacacaccgatgattaaggcgaagacgccggtggcaatgttgctgacggccatgacgaccccgacgcttaagcttcccatggaagtaaaactctgcagaaaccagagcacgggaacccggaagacgaagacgcggcagaagttgatggccagcgtcagtttcgtctttccgaagccatacaacagggccatgacggacgcggtgacgcccagcggaatcgcccccagcgcctcgaagcggtagatggagataatcatcttttgaaacgacggatcattgccggcaaagagacggctgagcgcatccagaaaatacagcgagcaggacatgagcacgatcccgatcaacaggttgacagcgagaacgcatccaaaggccttcagcgcgcggcggggctttcctgcgcccacactttggctgataatggccgatccgccttcctggaagccattctggggcatggtggtgatgccgccgatgttgttggagattcccagcgctcccacggtcagcgcgctgtagatcgtactcatggaattgatgataaccttgccgaaggagaaggccatcttctctgcaatgaccggaatggaaagtccgatcatgggaaatgtgacagcgggctttaaggagaccgctttcatggaaaagccgaatgcgttgtccttttgattcatgtttcgcacagccgcagccagcaaaaacagctgggaaaggattgtagccgtggaaatcatgctgattccgcactgaaatccgtagacgaacagggcggtagaggacatcttgatggcgataacggccatattcaggcggagaattctgccggaatttccacgggcccgctcaatggcgatataaatgttgttaaagaagctgatgaccatgccaaagagctccagccgaaagtacagagtcccttccgagataaaggcatccggcgtccgggcaagccttaaaaaccacggcgtgaagggaaccagcagagccagaatgacggcacctaagaccgcgcacatggcgaacagcgtgctgacccgtttctttaccagatcgaaatcaccggcaccgtaggcttcgcttattttcagactggacccgatggcgaggccgcctcccagggctgacagcatcaggctgatctgggataaataggccacggcggacacggaaccggcgctgatatgggccgccatcatagagtcaaagattttaaagagctgatttaaactctggtacagggccagcggcgttccgacgtagagaacgaccttccacatgttgccgtggagggcaaattcccggaaatgctgatcttttgcggagagcaccgcctttggtaacaattgcctggacatgaatcgttcctcctttgatgtatatgccattgcttccgatggatctgtatataagcatataaccgggagctttggaaatctacgaatttcatgaccaatcatcaaaatagtacggtttttttgacatgaccggttcctttgtgctatagtataggccgaagggatggtgatgtctggatgaaacgacatggtcaaatgtcggaagcgatgtcgaccggtatctttctgactctgtccggtggatttcaggatgcttatacgtattacacccgcgggaaggtttttgccaacgcccagacggggaatatcattttactcggacacaatgcgatgaacggagactttacggatgccttccggtacctagtgccggtgctggcctttgcgggcggaatctacatatcggaggttatacgcggtgtctaccgggagtacgggaagctgcactggcgccagatcgtggtggtgctggagattctgctcctgtttgtggtgggatttctcccgcagtccatgaacatggcggccaatattctggtgtcctttgtctgcgccatgcaggtggaggcgttccggaagatgaagggaagtgcctatgccagcacgatgtgcatcggtaatctgcgcagcgcgacggagatgctgtaccgctaccgccatacgaaggaaaagggctgtctggaaaaatgtctccggtattacggcgtaattctcgtctttggtatcggcgcagcgcttggaagctttatgacttccctgtttgaggagcggacgatctggatatcctgcggttttctgtttgtctgcttctgtattatgtttattaaagaagacatcgagggcgagcgaggtctggattgacagcggagcggattccctcttacaaccggatgaatggcaggaggtgctgtgatgaagggatatttggatacttcggaggaggttctgaaaaaactgaatacgaaacgaacaggcctgagtgcagaggaagcggccggcagacttatggcagatggaaagaataagctggaggaggcgaagccggttccgctttggaggcgttttttgagtcagctggccgatccgatgatcatcattctgattgcggcagcggtggtctctggaatgacggcggtctatgcgggggagtcgtttgcggatgtgatcattattatgatcgtcgttctcatcaatgcggtgctgggagtggcgcaggagagcaaggctgagaaagccatagctgccctgcaggagatcgcggcggccacttccaaagtaatgagggacggtaagcagcagacgatccggagcgaggagcttgtgcgaggcgatatcatcgtcctggaggccggagatgcggtgccggcagacggcaggattctggaatgcgccagcatgaaggtggaagaagccgctctgaccggggagtcggtgccggttctcaagacggaacgcgttctttcccaggaggaggggacgaaggacgttccactgggcgacaggaagaacatggtctacatgggaagcacggtcgtatatggccgcggagccgcggtcgtgacaggcaccggcatggatacggagatggggaagatcgcggatgccctgactcaggcaaaggataatgagacgccgcttcagggaaagctttcccagctgagccgaattctcagcgtgctggtgctcgccatctgcgtgattatatttgcagtcagcttactgcgcgcctatccggccatttccgggcatacggtcatggatacgtttatgatcgccgtgagcctggcggtggcagccataccggaaggactggcggccgttgtcaccatcgtgctctccatcggcgtcaccaacatgtccaggaaacatgctatcatccggaagctgacggccgtggagactcttgggtgcacccagatcatctgttccgacaaaacgggaacgctgacgcagaaccggatgaccgtcgtagaacacaccggatccgacgagacggcactggcggcggccatggcactctgcaacgacgctcatttaaacgataagaatgaggcggagggagaacccaccgaggcggctctcgcagcctacgcatggtccgcaggacttaaccagaacctcttaaaacaggagtatgtgcggatcggtgaggcacccttcgattccatgcggaagatgatgtcgaccgtacacgaaaaggcggatggaaccgtgattcagttcacgaaaggcgctccggatgaggttctgaaacgctgtactcacatactgtcggatggaaaggccgttccgctgcgtgaggaggacagggaaagaattctcctcgccaataaatcgctggccgaccaggctctccgtgtccttgcggctgctgcgagagagtacacggcccgccccgacggatgggaggccggagagctggagcagaagctctgtttcctcggtctcaccgggatgatcgacccggtgcgccccgaggtgctgcctgccatcgaagagtgccgcagagccggaatccgtcctattatgattaccggcgatcataaagacacggcggtggccatcgccatgcagcttggcatcatcacatcaccggaacaggccatcacaggcgctggtctcgacgagatatctgatgaggacttcggcaatgagattgaaaagtattccgtttacgccagggtccagccggagcacaaggtgagaatcgtaaatgggtggagagagaaaggctgtattaccgccatgacgggagacggagtcaacgacgcgccttccatcaagaatgcagatatcggtgtgggaatgggaattaccggaaccgatgtgacgaagaatgtggcggatatggtgctggcggacgataattttgccacgattgtctcagcggtgggagaggggcggagaatatacgataacattcgaaagtccatacagtttctcctgtcatccaatttatcagaggtgctgtccatcttttttgcgacgcttctcggctttgtcatcctgaagccggttcacctcctctggatcaatctgattaccgactgctttcctgcgctggcactgggcatggaggagccggaaaaggacgttatgagccggccgccccgcagcccgaaggaagggattttctcaggcggggtcggactgaatgtggtggttcagggaattgcggtgaccgtaatcaccctggcttcgtatctgatcggccattatctggaggcgggcgtgtgggagattacgaacagtgcggatggcatgaccatggcgtttctgactctgtccatgacggagatatttcactccttcaacatgcggtctctaaatcagtcggtatttacgttaaaacatcataatccgtggctgtggctgtccatggcggcttcctttctgtgcacgaccgtggttatctacgtcccgttcctgtccgatgcgtttgaatttgaacacatttctcttaccgagtatgcggtggcaatcggactggccttctgcattgttccgtttgtggaagggacgaaatggcttcagaggaggcggaaatgaggaacatcctctgcaaatgcctccgcttcggactgcagggtttccagaaagcgattgatatggtatccgtcagtcgccgcgtgatggcaggtaatggagagaggcatcataattctgcagtctttttcatagaatctgcctgcctcaacggacggaagatagtacggcttattctcataggagtgaaccgaaaaatgcttaaatgacacccagggaatacaggaaatggtataggcattggcgggaggtgtctgcccggcctgagccaggacgccgtgactgccgccgtacctcctctggttgtccaggtaggactgataaaacgccatgaaatcatctgtgtactccgtccacataaaggaaaaggtcttatcatcctcatgaaaggccgcgtaaagcggtgtgagtgtgtcgaagcagccaacctgcccgtccagttcggctattttgaattccttctgcatttgaagcgtcctggtgacgagccataagtaagcagggaagaacttgataccagcatgcttcagagccgttctcatcgccgtaacatcgagatcgacggtcagggaatatccggtcggagccattttcgagaaatagtaaaacatctgccccctcggccatgtctgcatgtcgagcggtgtaaatttaacagtttgatccattgtgatacctccttttcctctattatagggacttccaatgaaaatacaatcaacgctccgtagactgccgctgttgtccctgttccatttgaaaaaattagtgttttatggtaggatgaagaaaaccctgcacacaaaagaagtcagacactcacggcagtcgccaaatggacatggccgcatgcccgcttagcctgctgccttcgtgtgaataaacgatacaggagcatagaatgacggcttatgtaagtaagaatgagaaaacaaaataccggctggcagactctgtcaagcagtgcatgatgacgacgccagtggacaaaatcacggttcagaacatcgtggatggctgtgatatgacgcgccagaccttttacaggaattttaaggacaagtatgacttgatcaactggtacttcgataagctggtgctggaatcctttgcccggatcggcgtggagaagacggtctgccagagcctggaggagaagtttgaatttatcaagaaggagaaggtgttcttcaccgaggccttccgttcggatgattacaactccctgaaggaacacgattttgaactgattatggggttctacaggtcgctgattacgcgtaagacccataagcctctggaggaggagattcagtttttgctggagatgtactgccgcggatccgtctatatgactgtgaaatgggtcctgggcggcatgaagcagaccccgggagagatggcggccagcctggtggaagccatgccgccgcggctttcggctgtgtttcaggaggccgggctcgtataatgcggatcggagggcgttgcctggctgttggtataggaagtattgatattgtatagaaataaagttacagtttgcgggatttgtaacatttgttacaaacgaaggggattgtaactttatttttttgattggttttgttaaaataataacagaaagtaaatggtatccataagacccataaaagataggaaaaggagagattatcatggcaaacagaatcgttttgaatgaaacatcgtatcacggtgcaggtgcaatcaatgaaattccgggagaggtaacaaagagagggttccataaggcatttgttgcatccgatcctgatctggtaaaattcggcgtaacagcgaaggtgacaaagattttggaagagaatggaatggactacgaggtttattccaatatcaaaccaaacccaaccatagaaaacgtacagaccggtgttgaggcatttaagaaatccggtgcagactatattatcgctatcggcggcggttcctccatggatacctccaaggccgtaggcatcatcatcacgaatccagagtttgccgatgtcagaagcttagagggcgtggctccgaccaagaatccgtgtgttccgattctggctgttccgacgacagcgggtacggcggcagaagttaccatcaactacgtaattaccgacgttgagaagaaacgcaaattcgtctgtgttgatacacacgatattccggttgtcgctttcgttgatccggagatgatgtccagcatgccgaagggattaactgcttccacaggtatggatgcgctgacccatgcgatcgagggctataccacaaagggagccaatgagatcacagacatgttcaacttaaaggcgattgaaaagatcgcttccagcttaagagatgcggttgagaataagccggaaggccgtgaaggcatggctctgggccagtacttaaccggtatgggattctctaactgcggacttggcatcgttcattccatggctcacgccctgggcgccgtatacgacacaccgcacggtgttgccaatgccatcctgcttccgaccattatggaatacaatgcagatgctacgggtgagaagttccgcgccatcgctaaggccatgggtgtagagggaaccgagaccatgaccgtggaagagtaccgcaaagcggcagttgaggcagttaagaagctgtcccaggacgttggaattccagctgacttaacggctatcgttaaggaagaggatattcagttcctggctgagtccgctgtggcagatgcatgcgcacctggaaatcctaaggatgcgagtctggaagacattattgcgctgtataagagcctgatgtaagatcggtcggacgggagttcggacaaactgcagtgtaagagaagattaatagagcggagatgccgtttcatcgatgaagaatcattgatgaaacggcgttttttatgaattgcactttagtttggtgtctgctttgaaaaaatggtgtaatagtttatggcctcttcttccattaacgaaaaattagcctgcagcttttgaataatacgctgtttcgggatgttttcggaaatattatcctgaataaagacctggatgcctttttccttcccccgttgatacccttcctccatcaacatctgtccgactaatgtcatctgcatctcctcctccagttttttcgcgtatacccggtcaatgattttgtctgtaaaggtcaggattccggctattaccttcagctggccctccctgtcaggcagtcgtttaccgagatttacggctttttcaatcgtttcctgcttgcgctttttttcagggataattttctgatgttgtttgagatattcagaacatcaccatcttccggcagaatgcggaaatgggataggataatcatatgacaaatgtacagataagtcaagtgttatttacctgaataaatggtaattttgtttgcccggcattttagagtttaccgcagcatatgaaaaaccaggtttcccggatcaggcaagtacacagtttcagcacgcatcttcacaataatgcttctacgcatcatggcgatggaaattcttaaattcccgcggcgatatgccatactccttcttaaaggaacggtagaaggaagaatagtctggaaaaccgcagctctcccatatttcctggagcgggactccggacaggattccgtttttggccgcgatcagacggcgctggatcacacagtgatggaaggacacctgcatgttcttctgaaaggtgtgggagatggtggaggggcttacgagaaaatgcttcgccgtcccttccaacgtgatcttctcccttaagtgttcgtcaatgtagcggaataaatcatccaccagaacgcttttttccgcagccggcatctgcagatcctgatagtaataggtgcggcttatgtgggccatgaggctgatgactgcagtccgggtgcagtatccccagcccagctttcgctcctccgtctcctttaaggcagcggaagcagcggaaaaaagccctgaccacgtcgcccgggtggagcgcagaagatagctcccgcgcttctgacactgttcaaaggcaaaattcagatccggaaattcctcgcactgctgatgccagtaggcggcgttgatccagatgacgtaccgggaatacggttccttaagcggctccggaaagagcggctggtgactaactccgggcggaatgagcagaatatccccctgttggatgcgaaagcgcttgtcccctaaaagatactggatattgccgcttttgcaaagcaggatctcataaaatgtatggctgtgcaggaaaacatggccggtattgtctgtattggtctgaatgcggatttccgtacaggaatcctccatctgtatttctttccagaaattaatcataggacctccatggttaaaatgcataaaaagttgaaagaatattattgaaaataaataaaacctcataatttatttgcaagaattacaatgtataatgcaagatgcgcaatttaaattgctaaaactacacaatataatagaactataacaaatgaacataagaatttcaagtcttatgggaagaaaaggagaggttttatgaaagagatacgaaaatttggaatcagagaccagatcggatatgtatgcggtgatatggcgggcagctttgtgaacctgtatgtcgatgcatttttcctcacattctgtacgtatgtgctgggaatcaaggcagcatggatgggaagtatgttcctgtttgcaaggctgtgggatgcatttaacgatccgatgatcggttcctttccggacagatggcagataggcaagagcggggacaaattcaaaccctacattaagattgcaatgattccgctggctatatccggcctgctgtgttttgctgatgtcagcagctggggttccctggcgaaacacgtctgggtcgtattcgcttacatcgtatacggaatgagctataccggaacttccatgccatttggctccatggcctctgttgtgaccaatgacccgatcgagagaacgaagctttccagagcccgttccatcggcggcacaatcgtcggaattggagccatttcactggttcctcagttcgtattcaacaaagcgggcgaagtcgtgccgagtggtttcttcaaggtagcggtggtattcggaatcttatccatgatctgctactgcctgctgctgcattttaccacagagcgcgttcgtcagccgaaggtggaaggcgagaagttcaattacggcaaggtgttaaagagtgtatttaagaaccgtccaatgctgggcgttatgctggcaacggtaggaagccttctgttcatcaccggcaacagccagctgggaagttacctttacaaagaattctatcatgcgccgcaggtgctgacgctggtgtccttaatcagtattccgattatgctggtattcttcccgctgatcccgaagctgagccagaaatatggaaaacgcaacgtcattttagtatgctccggctacaaccttgtgatttccctgattctgtttatgatgccgattcagaacgtgtacttattcctggtgatcaacaccctggcgaccagcggacagacggcatttaccatgctgatctgggcatttgttacggactgcatcgattaccatgagtaccagaccggagagcgcagcgacggaagcctttactccatctacacattctccagaaagatcggttccacgctggcatccaccatcgcttccttctcactgggcgcgatcggctatatttccggtattgaggcacagactgccgctgtcgccggtcatattcgttccctctgcacctttattccggtagcgacctgcgtgctggagcttctgggcatcggactcgtatacaacctgaccaataagaagacgacggaaatgtacgcggtgctgaagaaacggagagatgagggcgagaaacaggcataggtgtgaggagatgcggaatggaaaaaaagatcgatattcatcttcatttgagtgaacgtccgattcccgacgggctgggaatgaagatatccagcggggcggaaatgctgccgcatctggatgagcttggaatcgggtttggaatcatcatgtcgtcgggcgagaaacaggcgatgttcggctccaacgcttcgtgcagaagaatcgcggaacagtatccggaccggtatgcctggatgtgcggcctggatgagacggaaccggagacggtatacgagaggttaaagcagtaccgggaagagggcgccgtcggtgtcggagaactggctgtcaaccacagattggatcatccgtttttagaggcggtatttcaggcggcggaagcacttggcctgccggtgctgtttcatatgagcccggaggaaggcttccagtacggtgtggtggatgagccggggctgccccttctggaacgggctttaaataagtacccaaaactgatatttatcggccacagccagccattctggcacgagatatcgggcggcgcggggaaatcccgggaagagcggtatgagtggggaaaagggccggtgacgcccggcggccggctgggtcagctgtttgaaaaatatccgaatttgtatggagatttgtcggccaacagcggcggatgcgccatgatgcgggatgaggcattcggcctggcgtttctggaggcctggaaggaccggctgatgtttggaacggacatggtaaatgtggacatggaatttccgctgggcggatggctggatcagaaggtggaggagggagcgctctccttcaccgcctgtcaggccattgtgagcggcaatgcaaaacgtatctttgggctgggccggaagctggctgtaaatgcagaagaaaagaccgatgagaaaacagaagagaagatggtgaaaggagattagggatggaggaaatgagaacgaggattctgccccggatgctgaatgacgaggcagaaacgtatctgacacgcaatgatgtcatcattgttccggtgggaacggtggaactccacgggggactgccccttgacagcgaaacggtaatcagcgaggcattcgcccttcggatggcggaggcggccgacgggctggtgctgacgggactgccgtatttctacgccggggccacggccatcggacgcggcacgactcaggtcagcgtgcgggaaggcatcgactatctgggagcgattgcgagaagccttctccgtcagggcttcaagcgccagatttacgtcagctttcacggccccgcccatatgacctgctgtccgatgatccgggatttcttcgatgagaccggcgtcccgattctctatatggatctgacgatgcagatgttccagagtgcgcgggatttattcaagacaatggacagttttcatgccatcacagtcggcgcgtaccagatgatgggccgtctggaggatgttccgtttaccacgggatactgccatcaggagccgcagacgacgaagccgtttgaccatctgttcagcctggcttaccagagcggcagcatcggctactgctttggcgacgcgaaggatcatatgagtactcctgcgatccctgacgcggccaggagaaaagaactggcggacgaaggggagatgctgatcaatgagatcgtaaagcgcctggatatgagaaccattacagaggaaatgaggtctttggaagcctttgagcaggaggttatggagcggtatccctggattccggccgcaggcgggcagaagagatgacggacgaaatcgggaaagaaacagagaaggaaatcgggaaagaaatgaaacaggaaatgatgaaatcagagatacagccggagtccggcgaatcgtcgaagctgatcgggacaccgtgcggagctgtgcgaggaactgtctccgcaaagggagactgcattgtctataaaggaatccgctatgcaaatgcgaaacgtttccagtaccctgaagaggtgacgcactgggacggcatctatgaggcagaccggttcggaaactgttcttatcagccgagagcgttctatgatgaggcaaaggtgccggaaaaggcattttattaccatgaattccgggagggagagtcctacacctacagcgaggactgcctgttcctaaacatctggacgccgctggagccagagaacgcaccggttctgttttacattcacggaggcggattcaagggcggatgcggccatgagaaacattttgacggtgcggcctactgccgtcagggaattcttgtggtgacgatcaactaccgcctgggacctcttggatttgcctgcatggaggagtggaaggatgaggcggggcatgccggcaattatgccatgtacgaccagatggcggccttatcatgggtccgccgcaatatcgctgcgtttggcggcaatccggaccggatcaccctgatgggacagtcggccggcgccatgagcgtgcagcagcactgcctctccccgctgacgaaaggcagcatctgcggagccattatgatgagcggtggcggtgtgagggaaggatttgccgccgcagcgtccctgaaggatgtggaaccattctggcgcgagctggatcttcgggtgaccgaggcgtgcggaaaggggctgagggaagcagagccctctgtaatctttgaagcatttaatgcactgtcgaaggagcgccccgacgcggccatggtctgcggcccgattgtggatggtgcgtttttgccggagccggccatggaaatcgtcagaaacggcggggcccacgagatcccttatctcatgggctctaccagtgaggatatcgttcctccgattgtacataagatggcaaagggatgggcaagactgcagtctgacctgggaagatgcccctcctatgcattcttctttgacaggcagctgccgggggatgaccggggcgcctggcattccgcggatttgtggtatgaattcggtacgctggaaaacagctggcgtccgtttgaggcctgggaccgcgagctttcggactgtatggtgcgctgcttttccaattttatccgcaccggagatcccaacggcggcggccttccccaatggctgcctatgaaaaagggccagaaccgcgtcatgcgtttcggtgataaaactgtggcaatgggatacgtctccattgcgaagctgaaccataccatgcgaacgaaaccttcggttggtgaataaataacccaaaaattgtccggattcccgtcaaaactgtcctagcagtgttggcgggaaatctgttatactgataacagaataataaaaggagtgtatgggacatgttatatccgattttaacgcagtcgaggggactgatggatttaagcggcgtctgggcatttaagctggatgacggccggggatttgaggaaaaatggtatgaacggccactggagtcagcgatgaccatgccggttccggcgtcttacaatgatttaaaagagggagaagcgttccgtgaccattacggctggtgcttctaccagagaacgctggcggtgccgtcctacatgacgggtcagcgtctggttctgcgttttgccgcagttacacacattgcaaaggtctatctaaacggtgaactgatcgcagagcataagggaggcttcctcccgtttgaggtacagatcaacgagtatctgagagaaggggaaaatctcctgacggtggcggtggacaaccggatcgaccatgccacccttccggtcggcagtgaagcgggcggcggaatgggagacttaatgggaatgggaggaggaaagacctccagaaagagaaacaatcccaacttcgatttctttaactactgtggaattacacgtccggtcaagctttatacgactccggcctcatatgtacaggatatcttcttaaacgcggaggtggagaatacgacagcgcgtattgcctaccaccttgagaccgtgggagacggaaccgcgaagatcgccgtatacacgaaggacggcagactggcggcggaagcggaaggaaccgacggtaccctggagatttccgatgttgtcctgtggcagccgctctgcgcctatttatatgaggtgagagtgaccttcggtgaggatgtctactcccttccttacggtgtccgcaccgtgaagacggaaggcggaaaattcctgatcaatggccgtccgttctatttcaagggctacggcaaacacgaggacacgttcccggccggccgagggcttaacatgcctatgaatacgaaggatatttccctgatgaagtggcagggagccaacagcttccgcaccagccattatccgtacagcgaagagatgatgcgtctgtgtgatgaagagggaatcgtggtgatcgacgagacaccggcagtcggagttcatttgaatttcgggggcggtgcgaacttcaaggacggaaagcgggtcaacaccttcgatccgccggaagagggcggaatccggacgcacgaacaccatatggacgtagtccgcgatatgattctgcgtgacaagaatcacgcctgtgttgtcatgtggagtattgccaacgaggccgattccggcggacctggtgcctacgcctactttaaaccgttatacgatctggcaagggagaccgatcctcagaaacgtccctgcaccatcgtcagtgtccagatgcctaattacaaggaggactgcaccattgagctgagcgacgtcttctgcttaaaccgctattacggctggtatgcctgcggcggcgatttagacatggcaaaggagctgtgccgggaagaactgaccttctggaattccctcggtaaaccgttcatgtatacagaatacggagcggacacggtaagcggcttccacgacacgactccggtgatgtacacggaggagtatcaggtagaatactataaggtcaatcacgaggtagcggactccctggagaatttcgtaggcgagcaggtatggaactttgccgattttgcaaccagccagagccttctccgggtgcagggcaacaaaaagggaatcttcacaagagacagaaagccgaagctggtcgcccattacctccgcgaccgctggacgaagattccggaatttggatataaaaaatagtagaacggtctgtttgctgtgataatgataaagtggtgtaaaaccgcatgaatactatctttctgtggctttgagcaccccggcgtaaatagcttcaaaatgtcatttgacgcttttttgacgcctgaactccacgaagggttataaaaagtaataaggagatataatggtgcactggtagggcgggaggccttatccgccctacatacctttccgttcttctcctttcccgtttcgggtaagaagatattacggagcaagcataggaagagggtaccctcttccgaaaaacgatttgatgggttccaaaatccttccccgtgttttgtgactgactatccataagtacatcctggttgtagaagaaaactgtcggaaaatatgctataatattttggaaaggaatcagacgagacaaggaaataattcttataaagtgcaaataaaaggggtgatagaatggaacatatagatggtaaatgggcaaaacaaatccttgactgccgaaataatgatggcatgtggggcaacttccatacgctgagtcgccctataagcggaaaggcctatacaacagagcaggcgctccgcaggctgcgaattttgggctatacaattgatgacgaggcgattaaaacgattgtaaatcgtatggaattgtgtgttaaaggcgaaaagaaaattgatgattattatgagaaaacccacgattgggttttatttgaaaggcttgtgctttcggcatggattagattgtttgatcctaaaaacgaaactgctttaggggttgcgcgtttttgggcggaattagcagaaacggcttttaacagaggtcaatataatcgtaacgacgatattgaaggatttacaagattgtacggaagaaagccaaaaagtgggtttgaaacaggctttggaatgttttatcatgcagtcttgctaaaagatgttttgtcacccgacacggaaagcttgttccttgattactacctatcacgacccgatggaatgtattatatttatggtaaacagattaataaaccgcccgaagtatttatgtcaagggaaacgagctgctatttagctgcacttgaagttttagctgagtatggggtggcaaaagaaaagcttatgtttgctgtggactggtttgacaaaaacaaagatgaaaacgaccaatgggattttggtgcaaaggcaaatgacggaatctattttccgctttccgactcttggagaaaagagaaatatagaaaggcggattgtagcgaaagggtttatgcttttcttgaaaaattgggtgtatagtcttgttactatatctttcacaaaatagcgtaaaaacagtattcatgtacccgcacaggcgcgagaatgagttggcaagggttttatcctctgtcctctcaatatgatgtttgactgcgtgacagttgaccatcccttgacgcttttttgacgctcgtgcttacaaagtgaagaaataaagagatataagcagagttaagaagatacatggaaaagtcttgaagagtttgattattttggaaaactgattggcagttggaagatcgactatgttgacaatagcaattcccgcatgataaaaggcgaatggcatttctcgtgggttcttgagggaatggcgatacaggatgtgattgtcttgcccggctttgaatacggaacaacgcttcgtgtctacaagcctgacgtacacgcctgggatgtcacatattgctatactggtaaaattatgcggtttgaagcggcgaagcaggatgataagattgttctcacaaacattgaggataaaagtagaaaatgggtttttgttaaaattgaggataagtattttcattggcaggatgttgcagtaaaagaggatggcgagtggcttgttaatttcgatttatatgccgagcgcgtctgatcaatataaatgcttcgactcattggtataaggcgtcgatacgatacgaatggccgtattccgttcagcagcggggtgcggccatttttttgctgtctgcctgcgcccccgtgaatgcgttgacagggccgaaagagtcaatttccgtgtatgatttggttaagatatgcgtagatcgcgcctggaaaaatgattacaatgagatagaaccaggggtggtgcgattcggattctgactggaccgaataagaacaataaacaacggaggagagaaaatgagacaaagtaaagtgatggcaattatgatggcggggattttatgcgtaacagcggccctgacaggctgcgtgaaggcaccggggaaagaacagaccgaggcgcaggccatggagccggcaccggtgaccctgtatttgacgcggcacgggaagaccatgctcaatacgacagggcgtatgcagggctggtgtgattctccgcttacggaggacggcgcggcggtggctgaaaaactgggacgcgggttaaaaaaggccggaattacctttgatgcggtttatacaagtgacagcggcagagcaatggaaacggcagagctgatcctgaagaataacggacagccggaggtatccttacagagaaatcccaaagtccgggaggtgtgctacggaatttacgagggtgccatgccggcggaagcatacacaccggctgcaaaggcactgggctatgacagtgtggacgctatgatgggagcggtcatgggaggcaagctgaaaattgaagaagcggtaactgcaatggcggaaaccgatgagagcaaaaccgcggagacgtgggagacggcacagaagcgagttatggacggaatccgtgagatcgcgggtgaggccgcagagcgcgggcagaagcaggttttggtggtttcacatgggatggccatatcagcagcagtggctgccatcgacccgaatgcagcagcgggagaactgggaaatgcctccatcacaaaaattatctatgacaacggaacgtttaccgtggaatcggtaaatgatatgagttatatagaagaatagagatcagcaagaggggaaaaatggatagaaaaggatagggaagacggcgattgaccgtattttccctatccttttttactcactataaagagcactctaaagtttaacggagcctattccttttccagctcttttgcacagctgagataatagtggcgcccgttcgcgctggtttccagcctggagagttgtctcagactttcggccttccaatggcgggcgtttgttttcccctcttcggatacggtgtctccggcaccaagaagaaggtcgcagagctcggaagcccactggaattccgactcctccagagccgttttgacagcggtggaaacggcctgctctccgccggccagttttatcagattgcgggagtatttcaccggtgcagtacggtttaaattggacggattgccgtcaaaccatcccacatatccctgatagatggcgcgcacagaccactgcactgtgccgtaatactcctgaagatacggcaggctgcggcaggtttcaggaagaaccacccgggcagcggtttcgtcctgggaaagcccctggctgatgcaggcgagagtctcatccaggatgtagcggatggcctccttaaaattaccgaggacctctgtgatccagtcgtgtcccaggaccggaagcatgtggcccggaagcagggcctcggccggataactcatgatgtgttccaggctgtccacccaggcggctatgtcgcggtactgtccgccgcggatggcatagagattgggccagcagccgtagtaattgtcgccgcagcacatgatccgctcctccggaagccagagaaagatctggtcgtccgtctcgccgaccgctgataccatctcgaaggcaactccatcgatggtgcgcgtgacggaatcttctgtataaagtgtggtgggaggaagaaacgagtaggcgccgtcaccaatggcgtggccttcccggatccccagaccctgggtaatgagttcttcatcggtcagtccatagccgaactgacggaaggtccttttgtttaagattggattaattcgttcggtcccttttaatacggccttcttgggcgcgaaggcgatgatctcctccaccgtgtcccggaacgctccgcagccgccccggtgatccggatggccgtgagtgaaaataatggtctttacgggtttatccgtcagacgggacagctcgtccttcaggcgtgcggctctggcatcggaatccagagtatcgaccagaatcagggacgtatccccttccacgataatacagttgctgtgcccccagccgaccgcgatccggacgcggtcggtgattgtgatcatctctttcggaaacgcggtatcattgaattcttttaatcttgcttcagcatcattacttaacaagtatatccctcccagcatttgattttttattaccatattttattttatcatattttacttctgacgagcgaatgaattatttcacagaggtcagtaaataaatttttgatacgagtttagatatctggccaggatttcatggttgcgttcataatttttggagtatgcgattccgcataatacgtttaaaataaactgtacggacagttcatagacaatgtttccgtttatgtcattcacccctgaatcctgtatctcgatccattcgtcggcaattctggaaagcggtgtgttggcaggcgtaagtatgatggttttggccttccgttgttttagaattgatgtgatatcgagcagacgccggttgttccccgtatggctgaccaggatggcggccgcatcggccggtgtcgagattgcctgataatactgggcgttattgggatcgtggatgacgacacggtagcccatggagagcaggcggtacatctgtggtttgaccaaatgcaggttgtcgccaaaaccgaagaactccagctgactgcaggagttgattaaattcgccgcccgcacaagcgtctgatagtcgatggactgctttgtctgctcgatggcggtttgttcaagatccgcgatcttctgtacaatggagtgaaccgtttcattcgtgttaatcgtcctgtctccggaggcgagaaatacggagttgatctcactgaaaaagcgtgccttaaaatgagaaaaaccatgtccgtcatctaacttcttaaccagccgcgtgacggtagagggactggtatagctggctttcgccagatcgcggaccgaaaaattgataatggtttcaggatattgcagcaaataacggataatattctgttctgcagaagaaaaatgttctgcctctctgagctgttccaggatattcattggaaaaccacctttccatggcgtatagattgaaaatctgtttcacggtaattatatcagatatcaggaaagagtgaaacaaacaaccagaatgtttcccggttcttgaataaattgtcccgaacggttaagctggaaaaaaagagggagaggtgtataggaaaatgtttcagaaagaatttctatggggcggggctgccgccgcgaatcaggcggagggcgcatgggacgaggacggaaaagggccgtccgcatcggatttatgcacaggaggctccagaaataaatcgaaacgaatcaccgtgaggcaggagaacggggtcttttatcccagtcatgaggccgtggatttttaccacaggtatcaggaggatatccgtttattcgcggaaatggggtttaaagtgtatcggatgtccataaactggagcagaatttttccgaccggcctggagaagacgccaaacgaggaaggactctggttttatgacagggtatttgcggagtgcagaaaatacggaatcgaaccatttgtaacgatttcccactatgaaatgccttacggacttacaaaagcatataatggctgggccggcagggagaccatcggatgttatctccgttactgtgaaacgctgtttaccagataccgtgatcaggtccgctactggctgacctttaatgaaattaactgtggtatgatacctgcgggcaatttcctttctctcggaattttaaatccggggacggaggaatttacaaagcagacggatattccggaaaaacggtttcaggcgcttcatcaccagtttgtggccagtgccatggcggtcactctcggacactccatccggcctgatttttctatcggatgtatgattgcctatatggtgacataccctctgacctgccgtcccgaggatgtcctgggagcaaaacagaaagaacagatgggaaaccagttttgcgcggatgtacaggtaagaggtgagtatccgcattttgcccgcaggttttttaaggaaaacggcatctccattcagatggagccgggggacgaggagatactgaaaaaagggacggtggatttctacagcttcagttattatacctcttcctgctggggaaccaatccggaaaaggcctcgtccggcaatctggctggaggagccgcaaatccctatttacagtcgagcgcatggggctggcagatcgatccggtcggactcaggaccgcgctgaacgatatttacggacgttaccggattcctgtcatggtggtggaaaatggcctgggagcggaagacacggtggaggaagacggccggatccacgatacgtatcggattgagtacttaagacagcatatcaggcagatgcgggaagccgtggaggacggagtggatctcatgggatatacggtctggagcgccatcgatctggtgagcgcgtcgacaggagagatggccaaacgctatggcttcgtctatgtggaccgccatgatgacggcagcggcagcatgaaacggctgcgcaaggactccttctactggtataaaaatgtaattgagagcaatggagaaaatctctaaaagggggaaatggatatgaaatacgatagtctggcaagagacatcatccgtcacgtgggcggaaaagagaatgtgatcgatgtggttcactgcgtcacgcgccttcgtttccggttaaaggacgagggaaaggccgacacggaaagattgaaagccatggatggtgtggtaaccgtgattcagagcggcggtcagtatcaggtggtgatcggcaatcaggtggcggaggtgtatgacgctgtgctggaagccggtggatttggaaatgccgtttcgcaggaggagaagccggagcagaaaggcggattgatgagccgtcttatcgatatcgtttcgggactgttcactccggttctgggcgttctggcggctaccggtatgattaagggactgaccggtatgcttgcggcgctgggaatcttaagcaccgcctccgggacgtatcagcttctctatatcattggcgacagcatgttctatttcctgcccatgtatttagggtttacggcagcaaaaaaatttaaactgaatgagttcgtgggaatgacgatcggcgcatgtctcgtatatcccagcctgactgcaattatggcaggggaaccattatttaaggtgatggaggggacgatactgcagtcgccggttcacttaaagtttttgggtctgccggtgctgctgatgcggtattcctccagcgtaattcccgtgattattgccgtgtactttgcggccaggctgcagaaccggattaagaagatccttcccgatgtggtgaagggatttctgacaccgtgtattacgctcctgatcattgtgccggccacatttctggtgattgggcctgcagcgacctggatgagccagattgtgggtgcggttacgatggcgatctacggtttgagcccgatggcggcaggctttcttctgggcggaacgtggcagcttctggtcatgttcgggcttcactggggaatggcgcctgtcggcttaaataatctcgtaacatacggctatgacgcggttacggtactcaaatcagccacgcctattgtcacggcgtgtgtggttcttgcagtagccctgcgcacaaaggataagaagatgaaggggatttgctggccggcctgtatatccagtctgttcggggtatccgaaccatccatatacggagtgacgcttccgctgaaacgtccgtttatcattacgctgctctgctcggccctgggcggagtgattatgggcgcatttcagacaaaggcatttatggcgggaggtatggggatattctccattcccagctatatcaatcctgagacagggattgacggaagtctgtacgggtatctgctggcgattgtgatttccggcgggcttggatttattctgacatggtttttcggactgagtccggagaagaaagaggactctgcatcttcgtccgcctccgatattgttataaacagtcctctaagggggcgggtgattccgcttgatcaggttgaggatgaggcattttcctgcggcgtgatgggaatgggagcagcagtgatcccgtctgagggcagagtacatgcgccggtggacggtgtggtgacagctctttttcctaccctgcacgccattgggatcacctctgacgaaggtgtggagatcctgattcatatcggaatggatacggtgaagctgaacggtgatggctttaaagcacatgccgcgcagggagacagggtccggaagggacagcttctcgtagagtttgacatggaaaaaatcaaacaggccggatattcactgacaacacctgtgattatcagcaatacgccggcttatcaggcggtgacagttctggcgcagacaggcgacggagcggggacggaaaatggtgcgaagatcagctgtgaggatggcctgctctgtatttccacatgctgacgaaaagaggaataattagatgaaagcaattatcatgatgtttgatactctgaccagaaaatatctttctgcttacggaaatgaatgggtgcataccccggagtttaagcgcctggaagcgcatacagtgacctttgataacttttatgcagccagtcttccgtgtatgccggccaggcgggatctgcatacgggcagatgcagctttctgcaccgtatgtggggaccgctggaaccctttgatgtttcggtgatggagcggttaaaggaacacggtgtatatacccatttggtgacagatcactcccattactgggaggatggcggtgcgacgtatcacaaccggtactcgacctgggagggattccgcggacaggaaggggaccggtggaagccctcgctgggtgagattccggtgccgcctctcggccgcctctccaaaaccggtgactcggtcagacagaactggactaaccgcagatttcagccggaagaaaaggatatgccttccgttaagacggtgactgcgggcctcgattttattaaggaattccatgagaaggatgactggctgttacagatcgagtgcttcgatcctcatgagccttttatctgtccgcaggaataccggcagctttatgaggatgaatacgagggtgcggtctttgactggcctgcttaccgcaaaacggattcggcagagcaccggggggaagtcggccatatcaggaagcagtatgcgtccctgatttcgatgtgtgaccggtatctcggaaaagtgctggacgccatggaccggtacggtctgtggagggataccatgctgattgtgaataccgatcacggattccttttgggagagcacgactggatgggaaagaacatccagcccgcctacgacgaaatcgcccacctgccattttttatctgggatcccaggtacaaaaagatgggagagcgcagagacggccttgcacagaccatcgatattgcgccgacactcatggatttcttcggtctggaagcagatgacaccatggacggacgaagtctgattccggttctggcggacgaaaagccggttcgtgaaaccgcggtatttggaatccatggaggccatgtaaacgtaacggacgggaagtatgtttatatgaaatgcgcctcctctgacgacaatcagcccttgtataattatacgcttatgccgactgcgatgcgcggttttataccgcaggtgtgcattgatgagatggaactgacagacggcgggagatattcccacggaagtaaagtgttaaagatcccgtgcagagttccaggaagctcatcccggtatggaaatctgttgtttgaggcagaggacggggagcagaagaacaatctggcggacggtggtcccttagaacaacagtatcggacgcttctgatccggtgcatggaggaaatgggggcgcccaaggagcagtttgtgcggctggggcttgatgcccggcaggaaaaccggaacaataccacgctgccgggtaaatagaatatgagcagatggaattcttgaataacctcccatttatgcgattgcaaaggaataattctcttatcagatttattatcccgcaatccgcataaatgggaggtttttatctgtactggccacaataccaaatactttacaaatgactgcttccctgagtataatgaacagtagcacagaaggagcggccaaaatgagtgatcgaagggaaaggaaaaaagtatgagtgtaggatttacgtgccaggcagtggttaaagataaacggtttgtaaagcagatgatccggatgctgggagaggagaagcggtatgaggtacggcaggaggaagactgtatgcgtgtgggattctgccggctgggagacgtgttttttcagttcagctctgggctggacggggaaattccggcgcagatggtctatggagagtgcacctccagtctggcgggagcgggatttcacgctgctgcggttcacttcgtggaggagcttgccagagagacggatctggaatttatcctggacgatgagaccggctatggggatgaccatgattttgaacggatgagagaagaacatttttacggatggctgaaaaacctggctgcggtatgccgggagcgggaagaaaaatggccggatgccgtgtccttcggtctctgctgggatctggatcagtacacgccggaggagattcctggcaccgtgtttactcccttcggccggttctcagtccagaaaatgctgggctgggtggaaaatgaggggattgagccctttgcaaaggaattttttatctggaatgagccgggaagagatgcgggatattacagaaacacagctctcagcctgatgtgggaagagtgctgtttcatgccgggcagcaggagtgagtgggataaacggatgaatgaccgtattattgatgatctggaaaaagcccttctcttagaccggggccttccatttccaacggaggaatacatcctgctctgccggctaaatggaagagagccggaggctgtggcagatgtgccggtgtatgaaccggattatcccatcggctacaagcgcgggaatgtgcgggataagatcggcaccatgacctttgtggttccgggctcctatctctatgaatacgatgaggacagcaattctcatctatggtatgacggtctggaggaggactggcatgcgatccggattacggcgttaaaaagcagagaggagagcccggagatcacggagcggattttcgacggcgcagagggagaaccgataagcggagagaatggctgcttagcgtaccggtttgcgtttgccggaaccacagagcatgagacggacggtccgtgcagccagtatgtgggggaagtggcaggcggatatcagatcgcactgataacggcttcctgtgaacacagggaggacgaatgggcggaagcgttttttcggagcatgtcccactcaccggaggcaaatctggaaaaatgataaagaaatggatatccggttatactaattccatcttagaatccaaggaggaacacaggatggaatttacaccctatatccgttttaacggaagctgccgggaggcggtggaattttatgcgaaggcgttcggagcggagcagccgaagtttctgaccttcggggagagcggggagaatcccgcatggccgatgccggaggaggcgaagaagctgattatgcatacggagatcactgtgaagggaaagaaactgatgttttccgatacatttccgggtatgccgtatgaacagggaaaccacattacgatcgctctcatgccggaggacgaagagacggccaggaagatcttcgggcatctgaaggaaggcggtaaggcagagatggagctttcggagacagcatggagcagctgtttcggtatggtgacggaccggtacggcatcggatggcagatcaatgtcctgagggaacactgacctggagggctgatcaggagcactgacctggaagaccgaccgggaacgcctgccggcagcaggggataaagcactttgcaaatgcggcggttagtgatatgatagatagaaatgttacaggtaaaaggattgaaacaccatgtcagacacagcaaatgatttttcaaaaggcagtatcgtatcaaatatcatgaagctggcggtccctatgaccatggcccagctgatcaatgtactctataatattatcgacaggatctacatcgggcggattccggagaatgccacgctggccttaaccggtctggggctctgtctgcccattatttccatggttatcgcgttcgccaatttatttggcatgggtggggcaccgctgtgctccatcgaacgcggccgcggcaataaggaggaggcggagctgatcatgggcaactccttcgtcctgatggtaatattcggaatcgggctgactgtggtgggactggccctcaaaaagcccatgctctatctgttcggggccagtgacaatacgtatccgtatgcggatcagtacataagcatctatcttctcggaagtattttcgtgatgatcggtctggggatgaacagcttcatcaactcgcaggggttcggtaccatcggcatgatgaccgtgctcctcggagcggtcgccaacattattctggaccccatctttatctttacctttcatatgggagtaagaggggcggcgcttgccacgatactgtcccagtttctgtctgccctctggatcgtaaagtttctgacgggcgggaaggcgattttaaggctgaaaacttcagcgttccggctgaagaagcagcgggttaagaacatcgtggccctcggcatgtcgggctttaccatggcgatcaccaacagctcggtacagatcatgtacaatgcgtcactgcagcattatggcggagatctgtacgtagggatcatgaccgtgatcaactctgtccgggaaatcatttccatgccggttaatggcctgactaacagcgcgcagccggtgatgggattcaattacggggcgggagagtataagcgggtgaaacgggccattgtattcatttcggtggtctccatcgcctatacgacggttatgtggctgtttgtccatggctttccggaattctttatccgcatcttcaatcaggacgcggatctggtcagggaaggaattccggccatgcggatctactatttcggctttttcatgatgtcgcttcagttcgccggccaatccgtgtttgtggcgctgggaaaagcgaagaatgcggtgttcttctcgattttcaggaaagtgatcatcgtgattccgcttatgctggtccttcctctgatgtttggactgggaacagacggcgtgcttatggcggaaccggtgtccaactttatcggcggggcggcctgcttcatcacgatgctgattacggtgtggccggagctcagcggtaagaaaaaataaacagggtcagggagaatagagatgaaagtgataacaaaagaatttataacgaacgtgctctcaaaggacaatgcagcctgtgcttccattcaggcgggagagacggtggtatttgagacgtatgactgctttacgaaccagttcctgccggaggaggccacctttgaaaatgtggtgagaaaaccggggaatccggccaccggccctctgtacattgagggagcgatgccgggggacatgcttaagatcgagattctggatatcgagctgggacctgtcggcattgtgatgctggggccgaacagcggaagcgagaggacggaatttccgaaaaaggtattaaaacgcgttcctgtcaaagatggaaaggcatactacgacggcaaagtggaaatcccggtggagccgatgatcggcgtgatcggtgtggcgccggcgggagagggcgtttctaccataactcccatggatcacggcggaaatatggactgcacccagatcaaaaagggcgccgtgctgtaccttcctgtctttgctgagggaggccttctgtccatgggtgatttccacgccatcatgggcgacggggaagtggaggactgcggcctggagatcgaaggccgggctacggttcgcgttgatgtggtgcggaatgagtactgcgtcccatatcccatgatcgagacggaggaccgtctgatcaccatcgcatcggcggaagatgtggaaggcgcctggcgggccgcgacgagacagatgtatgatttcatgagagaaaagattggaatggaggtttcggatgccggcatgcttctgacgatgacaggcaatctgatcatctgccagaccgtgaatccgatgaaaaccgttagaatggaactgcctcgttatataactcagagttatggcttttattcgatctttggttcctgaggaaaatgtcttgacttttatatggaaaagtataataatgaaaaaaattaagaattgaattaaaaatgaatcaggaaacaaatcaacgagggaaagaggaagatacgtatggaaaagaagaacatcgactggggaaatttaggatttggatatatacagacagaaaaaagatatgtatccaattttaaagatggagcttgggatgagggtaccctgaccgaggatgcgaatattgtattaaatgagtgcgcaggtgttctgcagtatgcgcagacgattttcgagggcttgaaagcatatactaccgaggatggccgtattgtaaccttccgtccggacttaaacggagagcgtatggagaattctgccagaaggcttgagatgccggtattcccgaaggagcgtttcgtggaggccgttacgaaggcagtggcggccaatgccgcatacgtgccgccatttggaagcggagcgacgctttatgtcagaccgtatatgtttggaagcaatccggttattggcgtgaagccggcggatgaataccagttccggatttttaccacaccggtaggtccttacttcaagggcggcgtaaaaccgctcaccatctgtgtcagcgatttcgaccgtgcggcacctcacggcacaggacatatcaaggcaggcttaaactatgccatgagcttacatgcgatcatggaagcccaccgcgccggatttgacgagaatatgtatttagaccccgcaacgagaacgaaggtggaggagacaggcggagccaacttcctgttcgtgactaaagataagaaggtggttattccgaagtctgaaagcattctgccgtcaatcacacgccgttccctgatggtggttgccagggactatctgggactggaagtggaggagagagaagtgcttttggaagaggtgaaggacttcgcggaatgcggactgtgtggtactgcggccgttatctccccggtgggcaagattgtggatcatgagagagaaatctgcctgccgagcggtatgagcgagatgggagaagtgacgaagaagctgtatgatacattgaccgggattcagatgggaagaattgaggcgccggaagggtggattcatgtgattgaataagccggggggtacgccctaaaacagaaagacgggaaaaagtggcggatcgcgcaaattacggagaactcctgaaggacttctcctccatgtgcacgatccgccactttttcccgcctttatgcttatgttccagcgaacctcggaaaaggaaaccgttcgttctcccgtccctcctgctccctggaccacccggaaggcctcgggctgtgtactggcggtgtggggaaaaacatgacgggattccggaaggttcgataaggcttttggattgccttttgtttgagattatggtatagttgtttcattaatttccatttatatctggagatctaatgccagttactggcatcatggctgttcggccgaagcgttcacagggaatatagaattggggtcagaaattgaataaaagaaagggagtggtctgtttatcgttactggatgcaggctttcgcaggatatcggatattaagggcctctatggtaatggttaaaaaatctgttgaaaagtacaactggtttcagtataatggaggtaaggaatatggtaaaagtgaataagaaatacaaagacagattatttcgaatggtatttaaccggaaagaggaactgctttccctgtataacgcgatcagtcactcagagtataccaatcctgaagagcttgagattaatacgctggatgatgtaatctacatgaagatgaagaatgatctcgcatttctgattgatgatgtcttaaatctctgggagcaccagtcgacctggaatcctaatatgccggttcgcggcacattatatatcgtagaggaatacaggaagtacattgagcagaatggacttaatctctacgggagcaggctgattacgcttccgattcctcagttttatgtgttctataacggtctgaaggaggaaccggattacatcgaactgaagctttcggatgcattttcccgcgttcattcagaactggagccgtgtatggagtttaaggcgattatgatgaatattaatcgcggtcataatgaggggctgatgaagcagtgttcgactctcagggagtatgcggaattcgtggcgcgtatcagggagaggacgaaggctggaacggcgctcgggacggcggttgaggacgtgatggattcctgtatccgggatggagtactggcggaatttttgtcgatccacagagcggaggtgttcgaggtgctgttgacggaatatgatgagcagcggcatattgccgatgaaaaggagttgagccgcagggaaggtaaagaagaaggcagaaaagagggcagagcggaaggtaccttagagaaagcgcatgaagtagcagtcaatctgtttgccaaaggtattagcgcggaggaagctgcctcgatatgcggagaagacagcagtctggtggcggaatggcatcgggaatgggaagcagcaaaataatgggaacagaataaaagaaccggaacagacaagttttgatggagcttgcctcgctgggtaatcagtgggcagctccttttgtcatgataagaggaaggcgggagatgtcagatgtcttacataacttataccgatgatgagatggagatcgtgaagagcgggatagaggttacagctcacagccctgtcagtctccgcttcccggtctgctccggctggcttatgcgtggtttccagttcaagtttcggggataagcacttctaaacgtgcagaatttttctaaaaaccagggaaaattcccaaactcgctgcgctcagacaggtgggaatttcccctgaacgaaaaatcctgcgcgttaagaattgctaatcccctgcaaagtcactggaaaccacgcataagccagccggagcagaccgggaagcggagaccgacagggctgtgaactgtaacggatagaggccataaggaatgtcctgatgggaacggatatggggaagaaggagagccttcttttctgtctggaccgttttctggatccgtggtttgggtatcagctgccgtatcaggacgccattgtggaccttctgcaggtggttatcgtcagtgacaatacgctttccgtgaaagaggcggcgctgcagctgatctgcgattacgcatggcctccgtttccggttctggaggagaattttgagcgtgtggaggcggaactgaggccggatgtctcttatgcaatgcatatggacaaagaaattgaaacggattcgtaaattactctttacaaaatgttcagaacaggttaggatgaaaattgtgtgcaaattttaatggtagcatagctgctatgtcattctgagttttgtattctggactcagaatgtggattgaaagaaagaaataaataagaagcaaaagatggccgtgatcaatggccgggaggggactggatatgacagcagtactgacaaaagcgtttgcgtttgttgcaatcatcgccatgggctatattctgaagcgggtaggattttttcacgcaaaggatttttacctgatttccaatatcgtgattaaaataacactgccggcggctattgtatcgaatttcagcaagataaccatggattattcactgcttgccatgtgcgtaatcggacttctctgcaattttgtgacgatcgccgtcggatatgggatcaatataagaaagccgaaggagacgagggcctttgccatgctcaatatgtcgggctacaatatcggcaatttcaccatgccctttgtgcagagctttttaagccctgtgggatttgcggccaccagtctgtttgacgcgggcaactccattatgtgtacggggatgacgtttacactggcaggtatggtggtgggagaggatgaaaagccgtctctcctgggaatgacgaagaagctcttttcctcgattccgtttgacgcatatatcgtcatgacaattctcagcattttaaaattgcagcttccggcagtgatgatcagcttcgcggatacagcgggcggcgccaatgcgtttctggcgctcctgatgcttgggatcggatttgaaatccacatggaccgggaaaaaattgcacagatcgtgcagattctcgtgatgcgctacggcattgcggttctgatggcggttggcttttatttctttgcccccttcgggctggaagtgcgccagactctggcaatcgtgtctctggggccggtggcctcgatcgctccggcatttacgggggccttgaatggagatgtagagatggcgagcgcggtcaattccctctccatcatcataagcatcgcagcgattacagccgcacttattatactgctgtaagtcaaaaaccccgctgcaagcaacggggcatcaaactcgcagcgccgcgagaggcgggttttttgaccctcgcggcagtcgttaggtggacccgcaagcgcgcccacctgactcgttgctcgcgggaataacaaaacgaacagacaagaggagtacaggaaactatgcatcagaagagaagccagtgggcaagcaacgtgggattcatactggcggcggcaggttctgccgtcggcctgggcaatatatggaagtttccgggaaaggtgggggcgtacggcggaggcgcgtttattctctgctatatcattatcgtcgccctgattggttttccggtaatgctggcggaattatcaatcggaaggaggacgcagaaaaatgtgatcggggcgttccggcagctggataagcgattcacattcgtgggaggaatcggcgttctgactctctttgtcattatgtcttactacagcattgtgggcggatgggtgatgaaatatatctgggtctatgcgagcggcgcgcatttcggagctgcggcgaatccgtaccagacgtatttcgcggacttcattgcgaagccggtggaaccgcttctttggggagcggcatttcttctcctctgtatctatgtggtggtaaagggcgtgtcttcaggaattgagcgtgtcagcaaggtcctgatgccggcgctgtttcttctccttttggcctgcgtgatccgggcagtcacgcttccgggggcgaaagagggacttacctttatgctgactattcggccggagtcgtttaacggcaacacgctggtaggggcattgggacaggccttcttttccctttccgtaggcatggggatcatggtgacgtacggttcctacgttccgaaggacgatcatctggtgaagagtgcggtcagcatctgcgcattggataccatggtggccatcctggcggcctttgcgatcatcccggttgtgtttgtcacgctgggggcggaaggactgggaatgggcggcggctttgccttcatggcgctgccggaggtgttcgccggatttccgggcggcaagctgttcggactggtgttctttatcctgctgttctttgcggcgctgaccagtgcgatcagtattcttgagagctgcgtggcatttatcagcgaagagtttcatttcagcaggctgaaatccacgattgtcttatcggtgccgatgacggtgctgagcgccggatactccctgtcgcagtccgatgcgagaggcattaagcttccgtggttcgatttctcacagggctttaccatgctgccgatgaatgcagtgatggaaaaatttacggacaacctgatgatccctctgggcgctctggccttctgcctgtttgtcggatgggtatgggggacgaagaacgcggtggaggagatcgaatcggagggaagatatccgatggtgatgaggagaacgtggagttttatcgtgagatttctggcgcctcttgtgatcgcggtgatactctattttacgctggggcgcggtgaagggctttcctgacgacgttctggtgcggaggttccgatgcggagcttccggtacggaggtactggtactgaagtactggtacggagcttccggttcgttccgcgacgggagtggattgaaacaagatgaaagataaaacgtattttgcctctgacaaaggggaaagatgatagaaaaggagaaacttaatgatgaagataacattaaaagacggttcagtaaaagaatacgaacaggcgatgtccgtttatgagattgcggcggatatcagcgaaggccttgcgagaaatgcctgcgcaggcgaggtggacggcaaggtagtggatttgagaactgcggtagagcaggactgcagcttaagtatcctgaccgttcatgatccggccggactggcggcctaccgtcacacgacgagccatgtgctggcacaggcggtgaagcatctctatccggaggcaaagctggccatcggaccgtccatcgagaacggtttttactatgattttgagactccttccttttccagggatgatttagataagattgaagccgagatgaagaagatcatcaaggccggcgaaaagctggagcgttttacgcttccgcgcgaggaagccatcaaatttatggaggaaaaaggggagccgtataaagtggagctgatccgggatttaccggaagacgcggagatctccttctaccgccagggggactttacggatttatgtgcaggacctcatctgatgagcacgaagccgatcaaggcctttaagctgacctcttcctcaggagcctactggaggggcagtgagaagaacaccatgctgacccgtgtctacggaacggcctttgcgaagaaggaagagctgaacgaatatctggagtacttagccaatatcaagaaccgcgaccacaacaagctgggacgtgagctggagctgttcgctaccgtggacgtaatcggacagggccttccattactgatgccgaagggcgcaaagatcatccagacgctacagagatggatcgaggatgaggaagagaaacgcggctatatgaggacgaagactcctctgatggcgaaaaaggatttatacgtgatttccgatcactgggatcactacaaagaaggaatgttcgtgctgggggacgaggagaaggacgacgaagtgttcgcactgcgccccatgacctgtccattccagtattacgtatacaaacagagccccaagtcctaccgcgacctgccatgcagatacggcgagacctccacacttttccgcaacgaggattccggtgagatgcacggactgacccgtgtgcgccagtttaccatttccgagggccatctcgtggtgagaccggaccagctggaggaggagtttaaaggctgtgtggacctggcaaaatactgcttgacgacgctgggactggaagaagacgtgacctaccgtatgtccaaatgggatcccgagaatgccggccattatctgggaaatgctgagatgtgggatgaagttgaggctgccatgagaaagattctcgacgacatcggcatcgagtacacggaagaagtgggcgaggctgccttctacggcccgaagctggatatccaggcgaaaaatgtatacggcaaggaagacaccatgatcaccattcagctggatatgttcttagccgaccggttcgacatgagcttcgtggataaggacggcaccaagaagcgtccgtatattatccaccgcacctccatgggctgctatgagagaacgctggcctggctgattgagaagtacgaaggcgcgttcccgacatggctgtgtccagaacaggtgagagtgctcccgatatccgagaagtatcatgattacgcggaaaaggtggaagcagagcttaaggctaacggtattctggcgactgtggatgagcgcgcggagaagatcggatacaagatcagagaggcgcgtctggccaagcttccgtacatgctggtcgttggacagaaggaagaggaggacggccttgtgtctgtccgcagccgttttaacggagacgaagggcagaagtccctttccgatttcatcgatgccatcagccgtgaaatccgtacaaaggaaattaaaacaattaatgtcgaatagttcctgtcccgcctgcgcataataactcctgcagaagcgatagaatttaagaattctcaaggagggatattccatgacgagattggactgtaacgtgacaaactgccttcacaatgcggaaaactgctgctgtaaggctgcaatcatcgtagagggcgagcaggcaaaagacacgtgtgacacgtgctgcggcagctttgacgagaataaggacggtgcttaccataacctgttcaagacacctgaaaacagactggaagtagactgtgaagcggtaaaatgtgtatacaacgaaggccgccactgttccgcggatcatatcggtatcgccggagacggtgcgagtgaggccagccacacggaatgtgcatcattcagggaaagataatagaaaataaaaacaccgcatggcgggaagcgtgtaagcttcttgccatgcggtgtttttgcctcctataggatcatgaaaaaggttccggccgtgataagcaggattccgatcagttttttgatggtgatctgctcatgcaggaaaagaaaagccaggatgacggtgagcacgatgctgaacttgtctacgggcactaccttggaggcttcccccatctgcagcgccttgtaatagcagatccaggaggcaccggtagcaaggccggaaagaatcaggaaaatccagcttttcctgccgatatcgggaagaccgctctgggtgttggtcatgaatacgacgacccacgccataatcacgaccacgacggtcctgaccgcggtagccagattggaattgacgccttcgatccccacttttgcgagtatggaggtcagggcggcaaaaaccgatgagaggagagcaaacaaaaaccacatggacgagattccccctttaaaatgcttcagaccgcatccgcagcttcataaaatgcggcggccatgaagcctgataggatcattgtaaaatatttcccgcaaatattcaatcctgaaaattcgtaaaacacctggagcgcagcgttcgcggcaatgcagattgtgtcaaaaaaaaaacaatggcttgacaggcgttgtcactgcatgatagtatgagactataaaaaaattagattacctaaaaatttttaagatttcagaatagtgaggaatgacgatgtcgggatactgttttgagcataagaggttttggtgtttcaataatacatggtggatgagagagagcagctgatgaggctgctctctctttaactttgtataatttttcacaatataatgaggaggtaggaatcatgatgaaagaaaacacggaacattgctgctgcgaagggtgtgacagcagtcctgagactttactcgggcggattggggagctggcttcggagtacaggggaaaggagggggcgctgatatctgtgcttcacatggcgcagggaatctatggatatctgcccctggaggtacaaaggacggttgcggacgcgctggatattccgctgtccgaggtatccggggtggtttccttttattccttcttttccacgcagccgagaggagagcacacgatccgcgtctgtctcggaacggcgtgctatgtgcggggcggaaagaagatatcggaacggcttcaggagcttttggatgtgaagatcggcgatacgacggaggaccggaagtttacgctggaggtggcgcgatgcatcggcgcctgcggtctggccccggcgatgtccattgacggccaggtttacaagcaggtgaatccggataagctggagcagattcttgcaagatattatgatggaccactctgctaggttcgtgaaagacctcaccaggcagagtggcatgtatcgcacgtaagagaccacaatacggtctctaagtgctcataactaggaggaataacggaatggaaaataaaatcacaaattctgccatgcttgcagatataaaaaaggattacatagaaaaaagaaaagcctttaaacgccggattctggtctgcggaggcgccggatgtatctcctctcactgcggagaggtacaggaggcgctcaaaatgtctctcgcagagcatcagctggagtcggaggtggagattctggtgacaggctgtatgggaacgtgtgcggcggggcccgttctcttagtggagccggacggaattttctacacggccatgaatccgcagaaggtggcggatctcgtggagcgccatctgatcggcggggaggtctgtgaagagtatacgttttacgatgcggaggaggaacgctacattccgaagctggatgacatcaatttctttaaagagcaggtccgcatcgcgctgcgcaactgcgggcgcatggagtttgcctccatggaagcttacattgcaagggatggctacgcggctgctgcgaaagcactggacggcttaagcagagaagaggtggtggagatcatgaaggcctccggactccgcggccgcggcggcgccggtttcccgacgggaatcaaatgggaatcgggcttgaaagccgtgtccgaggacggacagaaatatatggtctgcaacgccgatgaaggtgatcccggcgcgttcatggaccgcagtattctggaaggcgatcctcacagtatcatcgaaggcatgatgctgggcgcctatgccatcggcgcagacaagggttacgtctatgtcagggcggaatacccgatcgcagtggagcgcctttccgccgccatcgagcaggcgagagaccggggacttctgggaaccgatattctgggaagcggatttcagttcgatctggagatccggatcggcgcgggcgcgtttgtctgcggcgaggagacctcccttctggcgtccatagagggaaaacgcggggagccgaggcagaaaccgccgttcccgtttgagcggggcttattcgataagccgacgattatagacaacgtggagacgctggcaaatgcggcgcccattatcttgaacggcgcggagtggtatcggcagttcggcacggaaaagagcgcaggcaccaaggtattcgcccttgcgggagacattatcaacgcgggaattatcgaggtccccatgggaatacggctgggagacattatctataaaatcggcggaggcatcacgggaggacggaaattcaaggcgattcagtccggcggtccttccggcggatgtctcaccggggaacatttaaacacggcggtggattatgaatccctggcgaagctgggagccatcatgggatccggcggcctggtggttatgagtgaaaacacgtgtatggttgataccgccagatactttatggactttatccgtgatgagtcctgcggaaagtgtctgccctgccggaacggcacaaagcggatgctggagattctggaacggattacggaaggaaagggcgaggaaggcgatttggagcttctggaggagctggcggagaccatcaggcagacagccatgtgcggcctgggccagactgccccgaatccggtgctttccacactccgttatttcagaaatgaatacgaggaacatatttacgagaaacactgccgcgccggagtctgttccgagctgcagacgtcgccgtgccgcaacgcctgtccggccaacgtgtttgtacctggctatatcagcctgctctccgctggaaggtttgaggacgcataccggctgatccgccaggataatccattcccgtccgtctgcggccgcatctgtacgcatccgtgcgaggaccgctgccgccgtgcccaggtggacgaagccgtctccatctgttccttaaagcgcttcatcggagactatgtgcttcaggatggatacgagattccgaaggtggaggcgaagccggccacgggaaaacgaatttctgtcgtgggaggcggaccatccggtttgacctgtgcgtattacctggctaatttaggccatgaggttcacgtatacgaggcggagagtgttgccggcggagttctttactggggaattccggagtaccgccttccgaaggaggtgctggcgaaagaggtgaaggccatcgaacagagcggcgtgaacatccactgcaacgtaagaatcggggaggcgatctcctttgaggaattgaaaaatcagagcgacgccgtctacgtggcgatcggaacacagcagtcgagaaccctgggcataccgggtgaggatttaccgggtgtggaaaacggccttatcttcttaaaacgaatcggcttaaaacagagcctttcggttcccgaacgccttgtcgtcataggcggcggaagcacggccatggatgtggcgcgtacggcggtccggctcggctcaaaggaggtaacggtcgtataccgcagaaccgagcgggaaatgccggccggcgccgaggaggtaaaggaagcgagagaagagggaatccgcatcatcaccctggcatcccctgtgagaatcacagagaaagacggagctgtctgcggcatcgagctggtaaaacggcagcttacggattacggtccggatggccggcgcagaagtgcacatatcgagggctccgagtttcttctggagtgtgacggcatcataacggccatcaaccaggatgtggatcataaattccatcagacaacccagctggacttcgacagaaagggcaggattgacgttcatcagttcaccagccgcacttcggaggaaggcgtgtttgcgggaggcgatacgagcccgtggggagccaatgtcgccgtcaacgccattgccgacggaaagaaagcggccgtcaatatcgacaagtacttaggcggcagcggagaactgaacatgggcgagtggctggagattccggtgatccccgacatggaagtgaccgaaccgcatatgagattcccggtcagaacgcttcctgtggatgagaggatcgacaactttaaagaagtggcgtgcggcttccacaaattagacgcaatcggtgaggcgttccggtgcctgcactgtgacaggaggtaagagagatgataaagctgacaatcaatggaaaaacagtagaaatagaagatggagcgaccatcatggaggcagcggcaaaagccggcatcaaaatcccaagcctctgtcatttaaaagatgtccatacatacggttcctgccggatctgtgtcgtggaggtggctgggatgaagaatctccaggcctcctgcatcgtcagggcgagggagggcatggtggttcatacgaattcgccgaaggtccgtgcggccagaaaggtcctgtatgaactgctgctttccgaccatccggaggactgcttaagctgcaacagaaaccagaactgcgaactccaggagctgggctatgagctgggaatcacggagacccggctggagggcgagcgctccggatgcagcgtggatatttccccttccatcaccagggataccagcaaatgtatcctgtgccgccgctgtgtgaccgtgtgcaacgagatacagcacgtgggggccatacaggcgcagaaccgcggcttcgacacggtcatcagcccggctatggggcttccgcttaattccacggcctgcgccatgtgcggccagtgtacggtggtctgtcccaccggtgcgctgcaggagacggatggcttaagccgggtctggaaggcattaggcgacccgggcaagcgcgtggtcgttcaggtggcgcccgctgtccgcgcggcactcggcgaagaatttggccttccctgcgggactccggttaccgggaaaatggcttcggccctccacgagctgggctttgacgacgttttcgatacgctgttctctgcggatttaacgataattgaagaaggaacagagcttctgcaccggctttttgctgtgctcaccggaggggacgcggttctgccgatgattaccagctgttcaccgggatggatcaagcacatcgagcaccagttcccggaggagctggaccatttgtccacctgcaagagcccgcataccatgatgggagcggtggtaaaatcattctatgcggaccgcctttccatgaatccccgggatttgtatgtcgtctccgtgatgccgtgtacagcgaagaagtatgagatcgagaggggcgagatggaagtagacggaaaccgggatgtggatgcggttctgacgaccagggaactggcgcggatgatcaagtcggcgggcatcgatttcgtcaatctgccggaaggaagctttgacgcgccgctgggactctccacgggtgccgccgatatcttcggtgtaaccggcggtgttatggaggccgcgctgcgtaccgtgtacgaactggtaacgggacgggaactgccctttgaagggcttcacgtgacaccgatcgtgggtctggaacagattaagaccgcgtccttcgtcatcgaagacacgcttttggagtataagcatctggaaggcgtggaagtgaaggtggcggtaaccagcggactggaaggcgcctccatgctgatgagagaggtggcggacggcacctcgccgtaccatttcattgaggtcatgggatgtccgggcggctgcatcgcaggcggcggccagccgcgtccgaaggaagacgatttccggaaaaaacgtgcggcggcgctctacagcgaggacgaacacaagcctctgcgcaagtcccacgagaatccggatcttatgaagctgtatgaggagttcctgggagaacccggcggccatctggcccataagcttttgcatacccactacgtaaaacgcggaaaatataatgaattagtatagaaaaaaagaatagaaaaaaaagaaaggtaagatgaaagaagaatggagacggattcctcagggagctgaggcatccgtctccattgctgttatgcctgtattgtcttccggcataagatcataagggacgtaggatatggacttgcggccctcctccgggaggttgttataggattccagccaggcgaccgtatcctcgctcaaatccgattgacgaaagaaacggccttcatattctaacgttccgtttgccagaaacagcgtgtaatggtcgccgtccctgactgccatggcgccatcccagagagaaatgtagccgtcgcccttgtttccgaagttggactggccattttccgatggaacctttaagctgtcaatgacggaggagaagctgccgtcttccgttccgcaggtggggctggcggttctgcctgtgccgataaaaagggtatctctggcatagaacatgggggagagcggctcttttgcgatctggcccatctccatcagggacgccagggtatcgggatcgactgcatcgcgtcttccctttctgagaagctcacagctatagacggtggtctgtcccggccacgtctccataatgggcccggccttcatggaaacggcgtcgccgttgtccagcgtatccaagacgcttctgtcgccggaggcataggtgaagacgacgggaccgtagttgtcaatgaccagaatgccgtctccgctggtggattttaaaaatcgtccggttctgtcagaagcatcggaagggacctccgccgggatagaagagctgctttcctccgccggaccggaggcagatggcgcttccgcgctgcagtctgttgtcatgtgctccactgtggctttcggatcctccgacggttccgggctggcctggcggctggaacaggcactcagcgctgcggtgagaagaatggcggaaagcagtactgtttttttattcaaatttgattcctcctgttttttaatacggttctgtggtatcatatatttgatatgtttacaataccacaatcttccttattgttctttacttattccttgcaaatttcgtaagtttaagaaaacaataaaaaacacttgacttttcttctgtcatattgtagactataacaagttgtggaaacaacagtcaggaaagtaggtatccgcctcaccacggcacgagtaagtgaccctggttcatagccttatttacataggtatactgtgtagagactttgatggtgggtagcgtttgtctatctactttttttatgccctgacgggcagtaatgtgaattccgaccaaacacactataggaggtgcacgacaattagcgatttaatgattaacgaacaaattagagacaaggaagttcggttgattggtgaagatggagaacagttaggggttatgcctgcgagagacgccttacagatggcaaaagacgcagaactggaccttgtaaagattgctccgaccgcaaagccaccggtttgtaagattatcgattacggtaaatacagatacgaactggcaagaaaagaaaaagaagctaagaagaaacagaaggtaatcgaagtaaaggaagttcgtttatctcccaatattgacacaaatgacttaagtacaaagatgggcgccgcaaggaagttcctcgaaaaaggagataaagttaaggtaaccttacgtttcagaggtcgtgagatggcgcatatgtcaaagtcaagatatattcttgaagatttcgcaaaggaattggccgatatagcggttattgacaagccgtccaaagtggaaggaagaagcatggttatgtttttaacaccaaaacgttaatagaacattatcaaggaggaaaatacaatgcctaaattaaaaacaagcagagcagctgcaaagcgtttcaaaaagaccggtacaggaaagcttgtaagaaacaaagcttacaaatctcacatcttaactaagaagtctacaaagagaaaaagaaatcttagaaaagatatcgttacagacgcaaccaatgcaaaagtaatgaagaagattttaccatatttataggatcttaagttaagaaggaggaaaaaccgatggcaagaattaaaggcggtatgaacgctaagaagagacataacagagtgttaaagatggctaaaggctacagaggcgctcgttccaaacagtatagagtagcaaagcagtctgtaatgagagcattaaccagctcctatgcaggcagaaaagaaagaaagagacagttcagacagttatggattgcacgtatcaacgcagcagcacgtatcaatggcttatcctacagcgtatttatgcatggattaaagttagctggtgttgatttaaacagaaaagtcctggctgacatggctgttaatgatgcagaaggcttcgccaagttagcagaacttgctaagacaaaagtggcttaattgatgataaatctatcccctgtaaacgcgtgataagtgtttacaggggatttttgtgtttcgtctgtatttaccgttttgtcaatccccatttacaaccgccgggcagccttacaggatcaatttctccggtcctccaccagcagtgtctggatcgtatcgggagttgggctccagttcaatacgtaaagggtgtaggtgcgtcctggacgcagcgtgacggtggtggagaccagcgtgttctgcggctgggcggagcgggcgacgtttaccgtgtaggttccgcttcccatagagctgaagctggccgcctgattgaagttggtcgagttaaaatagacatttccgatgaccgtgttcaccggcccgctgtagtaggccagattgcagaccctgaaacatgcgtttgcattgggcgtcgggcaggtggtgtcggcgatcgatgtcaaatccagtccggtggacgaattgatcactgcgatggtggccatgccgtctccgacatacatggatttctgcacgtaggtatagccgtttccgactacggaaaatctgtgatagccctgtgagatctgctgatacctcgtcagctcagggaagtttaagttagagtataccggacggttatcgatgtagatggtaaaggcattatagccggttgccgcattcaggaaccggatgcttccgcgcgcccactggttggtgttgcagaacagacagggcatcggtgtcggaaagaacggcgggtaaaaaggtggataagaggggccttccggataagggcgatccgggataacgccatccgggtatggaggcataacggaaaaatcaggatcgatctcctcatcaaatggagggattacgttgccatagtccggtactaaaaatcccggatcgatatcgtcatcatttgcctgtgttgcggaaagaggaagcgtttcaaattgagtcataagatatttccttaattaatgtctttataattattgtattgtattttatcaaagtagtgacccaatcttgcgtttttctaaaaaacattttccgaaagggggcgtggacctgcttcgaaagatgatttcctgcgaaattcccgggcgctcatgccggtatacgttttaaatgcataggaaaagtgttcggaggaggagtagccggtcatctccgcgatctcaccgaccggcagttccgttgttttcagcagaacagaggcggcaccgatgcgggcttcggtccgtttcttcaaaaaggtgctgttgtaatactgccggatcagccgctccgtctgcctgggcgagaggtggatccgccgggcaagccgttccagcgtgatggtccggtattcatataaaaacgcttcctccacgatcagagacaggctgctgtccccggaagcatcttcaaagccgttttcaggaaccggatgatatgcctccggctccagataattgcgcgcaatacagacgatcagctgctgaaaaagagcggagagaagcggcctgtatcccggctttttctgttccagctcctgaaaaatcgtatcaaacaggggaagaacctgctgggtatcctgccccatccagaaggcctgttccaaaaagggcgtcaggaatgaggcgcgctccattttttcgaaatcagggaatacgcgcagatagatgcaggattccaccatgggatcagacggatcgggaatctgctcatgaaggatggaaggcccggtggtatagagcgtattctgtccgacgcgccgggggacgccgtctatcaccacggtcccggagccgtgccggatataatgaatctcataacaccctctgccgtgggcgtgggcggggatggaccggaccattctgccggtggataccatggagacctggaaggaaacatattctaatggaaaggtaaaattcaagctgttatcatgcataaaataccgcctccgtgccgcggaaatgaagttctgtgttctggttttcagacagaactatcatatcccgtaaataaaggaaagtcaaacataaacattcgaaaacacgacatataccggtaaaatacgtcagctccttctcttggattccaggccataattccgtatgatagagaggaacaggagtggctgcgctgtgcggtgaaccgcgcgcggaaaggagaagcatgtatcatttacaaccgtatttggaggaaatcgaccgggtgatcgaacaggggccctacacggatacgtgggaatcgctgtcggcctatgagccgccgaagtggtaccgggacggtaaatttggtatttttattcactggggaatctacagtgtcccagcatttggaaatgaatggtattcccgcaatatgtatatccaggggtcgaaggtatatgagcatcatacggcggtctatggaaaacacgaatcgttcggatataaggactttattccgctgtttacggcggaacagtttgatgcggccgcctgggcggatttgtttacggaggcgggggcatcctacgtagtgccggtggcggagcaccacgatggatttatgatgtaccgcagtgagatttcccgctggaatgcctgggagatggggccgaagagagatgttctgggtgaactgacagaggaatgccaaaagagggggctggtaaacggagcgtcgtcccatcgggcggagcactggtttttcatgggacacggcagagagttcgacagtgatatcaaggagccgatggagcggggggatttctactggccggccatgccggagccggaccatcacgacatctatggaaagccggagccgacaaaggagtacttagacgactggctggtccgcacctgcgagatcatcgaccgttatcatccgaagctcctgtatttcgactggtggattcagcacagcagcttcaaaccgtatttgcggaagctggcggcttactactataaccgcggagtccagtggggagaagcggtggtcatcaattataagcatgatgcatttccgttcgggacggcggttcccgatgtggagagaggccagtttgccgatgtaaagccgtttttctggcagacagacacggctatcgcgttaaattcctggtgctacacggaaaacaacgagtaccgcccggcggcggatattatctgcgacctgatcgatattgtcagcaaaaacggctgtctcttgctgaatgtggggcccaaggcagacgggaccatatcccaggaggacagaaacgtgctcctcgaaatcggaagatggctgaaggtcaacggcgaggcggtatacggcagcagggtctggagaaaatacggcgaaggtcccacaaaggtggtggagggccagtttaccgacggaatcagaaagcattttaccccgcgggatttccggtttacgacggccaatggttacttatacgctgccgtcctggcgtgcagtgaaagcggggaatacgtgattgaatccctggcggagcaggacgcgtcgaagctgccgaaattccatggaatcatccactcggtcgaggtcctgggaagcgcagagccgccggagtggagccgcgatgaaactgggcttcatatccggacgaaggtgtcaggcggttatccgctggtatttaagatatcggtggattgatggggaacctgcgctagagcgtgtttgaaaattcattcctgccatctgcacgccccacttcgcggtatatttagccccaattcagtcagcgtagcccactacgcctccttcatcggggccaaatctcccacaaagtgtgacgcacatctgtcagaaagcaattttcaaacacactctacggctgggaaagaatcctgtactcggaaggagatttccccgtaatggatttaaacgccttgctgaaataatactgatcggagtaaccgcagaactccgccacctggcgcacggaaaagtcggaattggcaaagtattcgcaggcgtggcggatccgcacggaggtcagatattcgatgggccgggttcccgtatatttcttgaacatgcggctgaaataggccggtgtcagggaaaaagcggtggcgatgtcattgatattgatgttggcggcgtagttcttctcgatgtattcctgaatatccgcggccattctggcagagtcggactggccggaggtgttgcagagggaggcgttctgcatgagctgctccacgaaaaacttcaggtaggagtagagatccccgtagctcttggagtaggtgatgtattcgtcgatctccaaatcaaagtccaccgaggtctgctccggaaaacagtctttaaacagcttttttaagcagtaatcgacggtgatctgggccgcgttctgactttcgagggcgtccaaaagcgcggccatggtctcctggaatctggcttcatcctggttcctgacacagaacaggaatttctgaagctgtgcggcggtcagataggatgacaggtcaggcatattcatttcaaatggtttggcttccagaagggaggagcgcccgaagagcaggtttcgctccgtataagtccgcatgatctgaacctccatgccgatgttgtccacatggcggatgcggcggctgatacagacggttatggggaggccggaccctgaggaagcggagagaacatcctctgcgatctgcctcgccgtcgtggattcgggattgctgcagcagacgagacagatgcgttcattctcgtgcctgccggagaataagtaagtcatctcgccttcctgcttccgggagcggcatgcggtttccaaaaggtgaaacgcccccacgtcctcatggggcagggcgtaatccagaaggaacgtgggataagagcctgccgtcatcagaagaagctgatagcagtcgtagggaaacgtcgtgttgatatgcccggtccgggtgccgggagactgaatcagggattcgaggagatggcggttgtaatctttctttttcatggagattttctctttcagctctgagagaacgtaggcgatgtcgtctgccgaaagcggctttaagagatactcatccacacccagcttcatggcctcccgggcaaattcaaagtcccggtatccgcttatgatgacggtgtggatctgcctgttttcggccttcagccgggagatcacctccaatccgctcaaaaacggcatcttgatatcggtaaagagaatatccggctggagctccgccgctttttcataggccgctctgccgtcggtggcggtcccggctatctccatatccggatcgcatttttcaattttcaagcacaaatccttcagaatcagtggctggtcttcggcgacgacgatcttaatcatgtgttatttctcctcttattgtgatgagacagccaccggggctgttctgattgtcggggcggctcacgcacagggcgcgggagccgccgttttctatgtacatatccacatttccgttaaaatacaggaacagcctgccgtagatattttttaatcccaggccgtcaatctccaggtcacggtataagtctgccgtttttctggagccgtaggcgtccttgaattcctggaaatcagagagcgcctccggtgaaaatccgctgccgttatcggcgatccgtatgaaccaggaggcgccttcgatggcgcagctgatggtgatgtgccacgggggcagacactcccggaagccatgcttgaaacagttttccactaacggctcgatggtcagcctgggcagaaagagattggccgtttcgagcggggcgtcaatggtgtaatcgaagctgccgtcataggagattttcatgaagtccaggtaattccgggtgtggcgtatctcctcggtgagcttggcctccgggctggaggaggtgatgtagcgcatcatggaagagaactgctggcacatcctggaggtgacctcgcttccgtaaatctcactggccgcgctgatggagtttaaggcgttgtagagaaaatgagggttaatctgggcctggagggccgctaagttggcgttgctctcccggatctgggcctcgtatacctccttgatggagtccttcagctttaccagcatctgattgaaggagctgttgatgagctcaaactcatcgaggaagtccgaggacaggtttaagggcgcatcctggtcgaggctcagcgcgttgatgtagcggatcatctggttcagcggcttcgaaacgatggagataatgacgaatatgatagcgcaggtggtggtcagaatgaggatgacggccaggatggtattggtcgcattctgcttccgatactgtgccagcgtgctctggttggagactaagagtacgtgaaaacggttatttaagatggagcttccgtaataggcgtattcatcgctgtagaaatccgcaacgccgtccctaaactgcgcaacaatatgatcgatggtttcagggggaaggacggtgacggtctcctcgtagggatagatctggcggcagccggaatcgaggattacgatctccttctcgtctccgaagctttcctggcggcagatggaatccaggtgggcatagggcacctggatctcgacgagtgtgtcctgagtcgtggtgatgtcggaaaaattccgtatggcggacagcacgaccttgtcgtcgccggaccacggggagaggtgggggcctaagtagagctggtcgtaccgtgcctccataagcttttcgaaggagcggtccgacgacagggcgcgttttaacaggccttcatcgtgaagatagaggcccgtataatagaaatagtccagattccggttgtagagaagcacattggagatgatgggtgaaaacatcatgttaatcagtgtcttctggattgtcctggtcttttccagctcctccatcatctgctgctgggtgagctgggaatcacggatattcaaattcagcaccgtgccccgcagcgtggaattctttgtgatggaggtggcggccacatccatctgctcatacagcgacgcgatctgggaggagatgcgctccagaaccatggcggagccgcggtaatcattatcctttgcatttttaagtgaagtcatggaaaataaaagggatacgaaaagcgcgatgaacaggaaaattccggccacggaaagaaacagccggaatttgaattttagtttgaaatgcctcttttttaaatccatgtcagtctccatttccttctgagtgattacctatatcatagcgaaaaatcggtggaatgacaatggaaaaaagagaggtcaaaaaaatacaaacggataagagaaatttttccattcgcttttttctgagaatcaattatactgattgcacaacagatgaaacaaattgaaggaggtagctatgaagaaaagacaattgacaggtgttctgttatgcgcggctcttgcggccggattgctggcaggctgcggccagaaggccgggacgacagaaacggcaggaggacagactgcggcggaaagccagaaggagactcagggagagaagaaggcaaagggcgtaaccatcaccgtaggcttaaaggcctcgcatgtggagatatccaatattgagacctttaagaaaggctgggaagaggctacgggcaacaccgtggatgtgcaggccatcgatgatgaccagttcgactccctgcttcagacgaagatgtccaccaacggcatgtgggatattttcattggagataccggtacgcaggcggcttcctaccagcatgcaaagaatctggtggatttgtcgtcagagccatgggtcgccaatttaaccgatacggggaaggaatttgtcacccacagcgacggtaaaatctactgtttccccaacggaggagtcaattccttcggaatcgtctataacaaagaggtattcgagaaaaacggcctggaagtgccgaagaccttcgaggaatttaacgcggtatgcgacacgttaaaggcggcaggcatcacaccggtctacgtgtccatggcggatgcctggaccgtaaaccagatcatcaacggcgagtggcccaatattctggctgctaatccggacgcgctggagaagctgaataagaacgagatccgctgggattcccttccggaattcaatgacttatacgtcagaatgaagggctgggtggacaacggatatgtgaacagcgacatggctaccgcaacgtacgagatgggacagaaggcaatcgcttccggaaccgccgccatgatgtacatgggcgactgggcagacccggagtatgccaagacagagccatccggaaaaggaaagatcggcatgttcgcggcgccgacgaaggatggcgacagccgtcttgcgatcgcaggccctggcggatattatatctcgaatcagtctgccaatgtagatgcggcaaaggatttcttaaattacatggcatctgatgagaatttaaagctgaacatggatacgagggcgtgtacatcggtctggaagtctgttgacgcggaaaatctaagcgtgacgcttcaggatacccagagctatatcgatcaggggctgacagaaattcattataaccagacgtatgtaattaccccatccgacgatgccaacagctcattcctttccgtccttctcggccagaagagcccggaggactgcgctaaaatatggagcgacgcggtgatcgtggtagggaagcagctcggattcgacggatttaagtaaggatttaaacatgtgattgaatcgtttggactgtcttacagagctttttcgggagcggttgtatgacagtcctttttaaaaggaggcagtcttgtgagcaagctggagaaaaagtattatccgctggtgtttgtcgtgccggcgctcatcatattcaccctgttttatgtctgctcgattgcgggcggctttgtgttttcctttacaaactggagcatctacaactttgaaagcccggagtttatcggcatcgagaattttaaggacttattcgcatcgcagagctttctgccagcgctcggccataccttttcgtttgccgtgattaccaccgtcattaaagtggggctgggcctggtgttcgccctccttttaaaccgggcgtttaagggccgggatttcttccgggccatcatattcctgccatgtaccatcggagcactggtgatcggttacgtcttcacctttattctccagccggacacgggcgtactcaacgagtttctgcgcggcatcggtcttagcgggctggcgctcaactggctgggagatccgaagatcgtcctgtttaccgtgtgcgccgtggaatcctggatgtggatcggattcaatacggccattattctggcgggccttcagtcgatctcgacggatgtctacgaggcggccaggctggacggggccagcgcatggcagacgacgcgccatatcacgcttcctctggtcacgccgtccattaataccaccattaccttatgcgtcatcggcggtttcaatatattcgatatcgtcatgtccatgacaaacggcgggccaaacggggcgacccaggtgatcagcaagctgtcgtatgacgccatgaggatcggaaccatgggatacgcctccgcgatcaacctgattcagttcctgctgatcgtgatcgttatttcaccgctgttaggcatactgagaagaagggagccggatatctgatgaatgcaaagacaaaaaagagagtttcccgcgggatcgtctatgtgatctgtgcgtttatggcgtttctcgtgctgtttccgtttctgctggtccttctgacctccttcaaatccgtgtctgaggccgcggtggtgacattttcccttccggaaaaattcctgtgggagaactttgcctacgtaatcgagaagggacagctgctgcgggcgtttaagaacagcctgattatcaccggctcggcggtgacgctgacggtgtttgtggcctcgatcacggcctttgtcctgacgcggcgttccgacaggctgagccggattttgagcaattacttcctgatcggcatgatcgcgcccctttctcttataccagaggtgatgatcgttaagtttttaggactcagcggaacctacgccgcgattattctgatccatgtggcttccaggctgccgctcagcatcatgatctattcgggcgtcatcaaggggattcccaggtccctggatgaatcggccatgctggagggctgcggactcttaagcatgttttaccgggtgatttttccgctgttaaagccggccgtcttcacaaatatcattatcacctttatgggggtatggaatgattttcagatctccctgtattttgtgacggatacggccaagaatacgctgcctctcagcatctacagctttgtcggctatatgacgtataaatggaactatgtgtgcgcgtttatcgttttgtcgatccttccgattcttttgatctacggtattgcacagaaatatatcgttgacgggatgattgcaggcgctgttaaaagctaaagcggccgaaggcagaaaaaactgacatgacaggaggaaaagccattgtgcagcatgatgaaacgaacaatagaaatccgggaggaaggcgtgccggaggagcttttagtggtaaggaaatcgtgggaggaaggcggcgtccgctttctgtcctggtccttccgcgctgagcgggagacggtatttccgccggtgcgggttcacattgcggttccggccagaggcatccattaccgctggacacccaagctccacttgatcaaggccctcaattcggactggttcgagaacctgtatgaaaccagcggattcacgggggcgccggtggagtgcctgatcgcgcaggataataaaaactgcgccgttatcgccctgtccgacacgcttcataccatcggactgaaaagcatccccgtggaggagaccgcacagtacgatgtggagatagccctgtttgaccgggaggcataccgtgggctggagtattcggttacggtgcgcgtggatacccgtcccctgccttattatgaagcgcttgcggacacggcaaaatggtgggagaccattcctggcaatgaaccggccgtggtgccggaagcggccagggagatcatgtattccacctggtacagttaccaccagaacgtggatgaaaagacgctgttcgcccaggcggagctggcgaaggaactcggatgcggcagccttcttctggatgacggatggcagacggaggataccggacgcggttatgcatactgcggagactggaaaccggctccctcgaaatttcctgatatggctggatttgtaaaacggatgcacgatatcggtatgggcgtcatcccatggtattcggttccctttatcggtgagcgatcgaaaaatttccagcggtttaaggacatgctcatcgacccggatgcggagcgggagtggcatgtgctggacccgcggtatcccgaggtcagggagtttttgatcggtatttatgaaaaagcgcttctggactgggatttagacggcttcaagctggactttgtggatgaattcgtggttacgccatttggcggaagggaggaggacgaaaggcgggactgtacttcctttaccgaggcggccgaccggctgatgaaagactgcatggcgcggttaaaaagccataaggcggatattatgctggaattccggcagacgtataacgggccgcgcatgcgcagcttcggcaatattttccgcgccgtggactgccccttcgacgatgcagagaaccatgtgcgcgtgacggacctccggctgatcgcaggggagagcgcggtgcactccgatatgctcatgtgggatcgggaggatactgcggcgggggcggccctgcagatgatacagattctgttcagcgtgccgcagctctccatgaggctggaggagcttccgcgggagcataaggagatgctggcttactactgcagcctgtggaaacggtataagaaggcgtttctggaggggagctttgaacctttgaacccgcagtgccgctataacgtcattgtgggccgtgcgggggagcagctggcctgcacttaccacagccgggagctggtctccgtgcgtcagccggcaagagagatggtgtttgtcaatggaaccgggagagagggactgcttctccgtctgggaagcggcaaaacggtgtataaaatgacggtgcgggagtgtacaggcgggctgctgtcctccggccttctgaccgacgacggcgggattctcaccgtaccggttccggcgggcggaacggttgaacttatagaagatggattggatttttctattcacaaatcttaaaaatatgcagattaaaataaaaagttttattatgcatgatatctaaaataatttaagaatacctaaaaaatatgttgactttattgataaaaatgtttataataaaacatatcaaatcaatgtttttgtgaaaattgaatagaaataaccgtatgcatcttgtatatgtccaggataatggcctggacgtttctatccgacttcctaaatgtcagggctacaggagcagcttttaagctgcctgtctccgacagccgggaagtcttttttgtttcatcgaaaaggacgtcctaaggaacaaaaaagacttcccggctggacggtatgacacgctatacggcagattccgattctcatggtaaagagggggtgaacgatgactgaaaagtgccgtagatgaaggaaactgcagacggtgctctctgctttgatgacagggggcggaacgcggacagttcagcagacgacggcaaaaacattgaaataagaaaatgataaaggagaatatcatgaaaagcaatgcagaagtcagcattaacaacatttacagactggacgggcgtgtgcctttgggaaaagcgatccccttcggtttgcagcatgtactggcaatgttcgtggcgaatctgactccaatcgtcatcgtgaccgcggcggcgggcttagagaccagccagacggctgccctgatccagaatgccatgttcatcgcaggggttgctacgctgattcagttgtatccggtctggcgcatcggtgcgaagcttccgatcgttatgggagtgagctttacgtttgtgaccattttgagctctgtgggggccaaatacggctatccctccatgctgggggccattctcgtcggcggcctggtggagggaactctgggcctgttcgccaagtactggcgaaagctgatttcccccatcgtatcggcctgtgtcgtgacctccatcggtttttcactcctgacagtgggcgcgcgctctttcggcggcggttattccgattccttcggttctgcaaccaacttattaatcggtaccgttacgctcctcagctgtattctgtttaatgtatttgcaaagtccttctggaaacagctttccgtcctgtttggcctggtggtgggctatgtgctcgccatcgtacttggcgttgtggatttgtccgggatgctggaaggcggtattttatcccttccgcgtattctgccgtttctgccggagtttcacgccggtgccattctgtctgtcgttgtgatcttcctggtgtcggcgacggagacgatcggcgacacgaccgccatggtcgtatccggtctcgaccgcgatattacggagaaagagatatccggctccctggcctgtgacggattcgccagcagtatctcctcgctgttcggatgtcttccggtaacctccttcagccagaacgtggggctgattgccatgacgaaggtcgtcaaccgttttaccatcatgacgggcgccatctgcatgattctggccggactgttcccgccgatcggctccttcttcgcatcacttccggatgccgttctgggcggatgtacgatcatgatgtttggctccatcatcatcagcggtgtgcagatgcttgcccgcgctggcttcagccagagaaacacgattatcagctccctgtctctgagcgtgggaatcggatttaccctgcttccggagatcttccagatcttccctgccatcctccaggatgtgtttgcggaaaactgtgtggcggtagtatttgttctggctctcgtacttaacctgattctgccggaaaatatggatattgagaaggcagtggaagagtaatcccatacttaacaacaaaaaaagatcagatatcgtgacagatatctgatctttttcttataagaaaaactccccgagtaggacttgaacctacgacagcgcggttaacagccgcgtgctctaccgactgagctatcgaggaatatagacattattatacccaatggaaataaaatgtcaagggtattttggaaaaaagtaaaaaatagttttttcaaagttaaggatgtgttaagtattctgataaaggattgaatcccgggcatgtttgtgctaacttagccatatcataaaaagagaggtgcatgatgagtgaacatttgcgtaaattgagcccgggccggattgtcgtgctgggctttgctttcgttattttgacaggaagcctgattctgtggctccccatttcggcaaacgagggggttcacgtgaactacatagacgccctgtttacgtccaccagcgcggtgtgcgtgacggggctgatcgcagtagatacggcggatacctttaatgtattcggcaggacggtggtagctctcttaatccagatcggcggtctgggagttacctgcgtcggcgtcggctttattctgctggcaggcaagaagataggaattcatggccgcgtgctgatccgcgattccatgaacttaacaacggtaaagggcgtggtggcgctggtggaatccattctctttatgacgctgctgttcgagggcatcggcgcgtttttaagctttttggtattttccagggattatccggctctggatgcgctgggaatcagcgtgttccattccgtggcggcgtttaacaactcgggttttgacatcctgggaggactgacaaacctgattccatatcaggacaacgtcctcttgaatcttaccacctgcggcctgattatcttcggcggcctgggatttctcgtaatccgggaggtgtgggcgaagcgctcctggaagaagctgagcctccactcgaaggtcgtcattctgacctctgccgtgctgctggctgcgggaaccatactgttaaaaatgacagaggagattacgtggctgggtgccctgtttcagagtacttccgccagaacagcgggattctccacttatccaatcggaaatttttccaacgcgggcctgtttgtcctgacgatcctgatgtttctgggagcgtcgccgggatcgaccggaggcggtatcaagactacgaccacatttgtgctggtaaagagcatgttcagcgcggcgaccaacaggcactgcagcgcgttcaaacgccggatttcgccggaggtgatctcacaggcatttatcatcaccatactggcgctgggagtggtctgtatgcagacctttctgatgtgcctcgtggagccggaatacgatttcatgaagcttctgtttgagacggtcagcgcgttcggaaccgtaggcctttccaccggaattacgccggatttaaacggatgcgcgaagctgattctggtgcttaccatgtttatcggaaggcttggaccgcttaccatcgcgaccatttggagctttaaaccgaaggcgggcgcgtggtactcggaagaaactattacaatagggtagaggagagagacaatgaaacgcaggaaagatacgatagagtatggaattataggtctgggaagattcgggatcgcactggcgaccgccctttccgaggcaggaaaagaagttatggtggttgacaacacggagagcaaggtaaagcagatccgtgatatggtctcggaggccttcgtcgtcgagggcattgacaaggcgtcgttcgagagcgccggaattcagaactgtgagacggtgatcgtatgcattggtgagaagatcgataccagtatactggccactctgaccgtcatatccatgggagtgcccagggtcatatcgaaggccaccagcgcggagcacggctgtgtgctggagaagatcggagccgaggtggtgtacccggagaaagatatcgccatccgtctggccaggcgcctcgtatcgccccatgcgctggatttcatcagcctgaacgacgacatcgcggtctcggagatccggcttacaacggtgctggagggcaagagcgtgatggaggcgggaatacgcaaccagttcggcttaaatatcgtggcgatggagcgggagcatgatacaaccattgacattcagcccaactaccggtttcggaaggaagacgtgatcgtggtgatcggaaagcgggataatatcaatcggtttgaggcgtatttgtcggaggaataagaagtaaaggtgaagaggctgttcggaaagaaaaaggtattccggacagcctctttgtctgctcgtacagagggtcagacatcctgccagtatgagcgtttggcggcatagggatttataaatatccaagaaattccagatggagttttaagccttctgccagcggtgtatcgggcagccggacgccggcggcctttagtttcgataaatcgtagatccggtggcataaatggccggaatattcgggatgggcctcaaggtatccggtgagaggaagttcccgtatggtgatttccacaccgagaagccttcccaggatttcgtaatacaggcggttttccaccgcttccgggtcgccgatgcagaagatctgctgaaaggcaccttcccggtttaccgagtccagcatggtgcgcgccagatcgcggacgaagaccggctgtgtgatgtggattccgccggttacgagggagaggggctgtcctgccagaatgagatccggcagctccttctggcggctgtgctccggatagcagcccagcagaaagcctgggcagtagatatggccgggacgaaagagcgtaacgttaagtctgtgctccccttctccggaaaaatagcggagaaagacgttctccatcttccgcttgttccctgcatagctgcattcctccggggcgcccttttcctccacgaagaatccgtcttccgtctgaggtgtcgccttgtgcgccggatcgtagacggagtcggtcgagatgaccaccagccggctggtcacgaaaggcagcacctccaggtcctgctctgcatggcgttcgttcatgcagatgcagtcgaaaaccacatcccaggtgacacccgctcccaggatggccttcttaaatccttccctgtcgtcccggtccgcacagagcgggataattccagcgccgagagggcgttttcccctggtgagcgcccagacctcatacgtttctttcgccatggaagccagtatgccgcttaagccgccgcttcctccgattatcagtgctttcattcttcttttcctcctggtagtaaaatcgtgtcttcttttttctttcttctttccggcggaaacatgccggagggcggaatccccttcttctccttaaacagcttgctgaagtagaagatatctgaaaatccgcattgcagcgccacctcactgacgctgtattccccgctttttaacatattctccgcatagtttaaacggagtgagatgagatactgcttgaaggtcatccccatggcctcccggaacagacttccgtagtagacgggatggagatggaactggcgggccatcagatcgatggtcagcggttccgaataatgcatgctcatatagcggatgctgtttttgatgcgggggtcttcctggcttaaatggttttcattcaggatcaggttggatatctgatacaggatgaggcataggattccgcgtatcttcagcatatatccaaaatccctctgcagccattcctcgtggatttcgtggaaacgcgagatcagccgggggatgatcccgatgtggctgatgatgggaagcggcaggcgggcctcctggccgaactgatcccgcagaaagatgttggtggagtagcactccatcaggtcttccgggatgttgacggccgcccggtaggtgttctgagggatgcagattaaatcgcctttttttacagtataagtgtggcctccgatgttgtactcggcctttccgtctatgacgtatgtaatgtcgatgaagggaatcacattcgcatcgattttccagttgggcgtgcacttcctgtggatgtaataatgaagttcaggaatcatattgttaaagtcagggatcataaaagctccttttcctcccgtgatgcagagataacgctgtctgtggtatggcttcattatagaggaggaaaaacaattgcgcaacggagtttttaaacagaattttatctttaataattacaaatggcctttgattccttcattcttttttattgtgcaacttgttataatgcatttgtaaataaacaacatttaaaaacactttgcacagggaaataacgccgcccggcggaaccggtctctgcgcaaaagtaaaaagtataaaggagggaagaccatgaccggcgtcgcagtgatcggaacaggcgtaatttcagagagccatatcgaggcgtatctggcctttcaggacaggtgccatatcgcagcattgtgcgatctcgttccccaaaaggcggaggcgctgaaagaaaaataccatttaaaagacaccgcagtttacagcggctgcaaagagatggcagagcggagcgacatccgtctggtcagcatctgtaccccgccgtttacccatggggagagcgctgtgatctgcatgaaagcgggaaaacacgtcctggtggaaaagcccatggcgtcttcactggaagagtgtgacgagatgatgcgggttcagcgggagaccggctgttatctgggggttgtctctcaaaaccgctaccttcgggacaaccggagcttaaagagcgtaatctcctccggagccgtgggaaaggtcttgttcgggcaggtggaatccctgtggttcagaggccgggaatactacgatctatggtggcggggcacgtgggaaatggaaggcggaggctgtaccctaaaccacgccgtacatcagatcgatctgctgaactggatcatgggagctccccgcacggtgacggctgtcctggggaatgcagcacatgacaatgccgaggtggaggatgtgtccgccgcgattcttacctatgaaagcggcgcgctcgtgacggtaacggcctctctcgtaacgcacggggaagggcagaggctgagctttcagtgcgaaaaggcgggcgtggcgtcgccgtggagggcggtgagcagcaggtccgcatcaacgggctttcctgtcgaaaatgaggcgtttgaggcacagcttcagacgcgttaccaggagatgccgccgccccggtataccggtcataaaggccagatcgatacggtgctgcgtttcctggagagcggggaactgccgccggagagcagcgcggacggccgcctggcgctggaggtgataaccgccatataccagtcgggctttacgggccagacggtcacgctgccgctgccgaaagatgcgcccctttatacgaaaaaaggatttttggcaaatggaaagcatttttatgagaaagaggcgcatcagaaatgaggcgctgtggaggacggaaatcatgcacggacggagagacttctgctggctggcaaaacaggtgcaaaacaaaaacataattacttattatctggatgatgggaagaaaacggcagttacagagaccattgagcgggaaatgccgctgctgtttaaagaaatcagacgatccggttcgccggatgcctcgattgcttttttaccgggagatgaaacggcgctggggacagaagggtaccggatcgtggagacggagcacggttataagatagaaagtgcgtctcctgcgggatatttatacggtatgtacgggctgcaccggcttctgaccacacaaaatgaggctggatttccgtatgagtcggtaccggatcagagcatccgcatgattgatcattgggataatttcgacggttccatcgagcgcggttacgcgggagagtccatattttacgatcacaacacctttcggggggatatggagcttatccggcagtatgcaagactgctggcctcggtggggatcaatgcggttctgatcaacaatgtcaatgtacacagaccggaaacattttttgtaacaggggaagcccttgcggaaatcagaaggatatccgatgtcctggctgcttacggaattaagacgtacctatccgttaattttgcggcgcccatcacggtgggacggttaaagagcgcagatcccctggagccggaggtggcttcgtggtgggaggagacggttaaacgaatctatgaggagattcctgattttgccggcttcgtggtaaaggcggattcggaaggagaacccgggccgttcacctacggaaggaaccatgacgacggtgccaatatgctggcgagggcggcagggccctacggaggagtcattatctggcgctgcttcgtatacgactgctcccaggactggtggaaccgggaggcggaccgcgcacgcgccgcttatgatatcttcgaacctctggacggcaggttcctggacaacgtgattcttcagatcaagaacggccccatcgatttccagatcagagaaccggtgtccccgctgttcggagctttaaaaaagacaaatcaaattctggaatttcagattacacaggagtataccggacatcagagggatatctgttatctcattccgatgtggaaggaaaccatggattttgatacgaaacacggcaaaagcctgacggtgaaggaggcggtgagagagaactcccctgtccgcggccgatccggcattgcgggcgtcggaaacgtgggaatggatgccaactggacgggcagcaagctggcccaggccaatctctatggcttcggaaggctggtctggaaccatgaattatcatcggaggcgattgccgaagaatgggtccgccagagcttttgcctgaccgaagaaaagtgcggtaagctggcggcggttctgacgacatcgagggacgtgtacgaggcttatacctgtcctcttggcgttggcttcatgtgtaaacccgccgtccactacggtgtcgatatcgatggctatgagtacgaccggtgggggacataccactatgccgacagagacggagtcggaagggacaggaccgtgaagacggggacctcctatacgaggcagtattccgacgcgcgattttctgaatatgaggacctttcgtcctgccccgatgagctgctgctctttttccaccatgtgccgtacacccatgtgctgcattcgggaaaaacggtgattcagcacatctacgacactcattttgagggcgtggagcgggtgagagagtatcaggcagtatgggaaagcttaaaggattccctggatgaggagagctacttaaatatgaaggagcgcctcgtctggcagctggaaaacgccgtcagctggcgtgaccaggtaaacacgtacttttaccgtaagtcgggaatccccgatgaaaagggtagaaaaatataccaataaataaaaagaaagaggtagtatgatgaaaaaatggagtaaagcaggtatcgtatgtgcggccgtactggcagcgagcatggcaatgaccgcgtgcggcggcaagaccgcagaaacgggcaataccggggaagccggaagcaccggagcggccgggacggagaaggcagcggacgtaaaaacaccggaggcgtctaaagcatcgggagaaaccgcgaaattaagcttttcctggtggggcaatgacgaccgccatcaggccacacagaacgccatcgatgccttcaacgcggctcacgccggcgccatcgaagtgaccggagagccttccggcttcggcaacctggaagagacctttgccacccgctatgcaggcggaaccgccgcagatgtcatgactgtcaactatccctgggttatccagtacagtccaaacggagagggcttctacgatctcgatcaggtgaaggatatctttgatttctcccagtacgacgagggattcctggaatttggaaagacgggcggcaagatgcaggcagtcccatacggccagaacacgctgggcttatacgtcaataaatccgcatttgacagagccggtatcaccgagcttccaacgacgttcgaggaatataagacggcggcggaaatctttacccagcaggatcccaatgcgtatatgatcgtcagccctacgttccgtttcgcagcagtctactatctgcagcagaagacagggaagggcgaatttgcagaagatttaagcatgaattacaccgtggatgactataaggaagcgattctctggtataaggacttagcggatgcccatgtcttctgttccagaaaagattatatcgagaatgtaggcaatgagccggtatccattgcccagaatgcaaaatatatcaatggcggctacgctggcgtactggaatggaccggaggaatcgcttcgaacgccaagacgctggaggacaagggggacgaactggtggtagcgccgctccctgtgatcgacggagccgtatttgaaggaactatggcaaagccctccctgctgtttgcaatctccagggattccaggaatccaaaggaagcggctgaatttttacagtatatcttaaacgatccggaaggaacgaagctcatgggctccacccgcggcatggtggcttccagggcggccaaggcttccttagaggcagacggacagatcacaggagccgtaaagcaagcctacgactttaccgatgcagcgaaagtaatcaacaattctccgatctttgagaacgccatatttaccaattcctatgaaagtaattacgagaagtttgagtttggaaagagcacggccgaggaagctgcgcaggccatctttgacgccaccagcgagcaggttgcaaaactgaaacaggactacggcaaataaagagcacgcaggaaggaggagattctttgagaaagagcaaaatgggtctggtgtatatcctcccatggctgatcggtatggtttttcttaccctgtatccgtttattaacgcgctggttatcagttttacggattacaatctcgtgagagaaccgaatttcattggtctggccaactacaccaagttgtttcatgatgaagattttttaggtacgcttaccgcaacgttaaaatacactgtgattacggtgccattacagctggcgtttgccctgtttattgcatacatattgaattttaagcttaagggtattaactttttccggacagcctactatattccgtccctgctgggaggaaatgtggcggtggcggtgctgtggagattcctgtttcagcaggacgggcttatcaaccgtatcattggcgttgtggggatacagccggtggcatggctctcttccccgggcggggcgatgagtgtcattataatcctgaaggtctggcagtttggttctgcgatgctgatctttctggccgctctcaaggacgtgccccaggatctctatgaggcggccagcgtggacggctctaccaagctccattcctttatccatattaccatgccgctgatcacacctacgattttcttcaatctggtcatgcagctggtcaatgcgttccaggaattcaacggcccgtatcttgtaacggggaagggaccgttaaatgccacctatctgacttccatgtatatttatgacaatgcatttaagtactttaacatggggtatgccagtgccgccagctggattctgttcctcatcatcgtggctgtgaccctgatcctctttgcgacacaggacaagtgggtctattattcggacggaggtaattaaaagatggagaaaacgcgaggattcagcgaagtggaagtgcggaggcacagacgggtggtcatcagctctgtcatccgttatatcgtcctgattgtcgtggcgctcgtcatgatctatccgattatatggctggtgggcgctacctttaaaagcaataacgaaatatttacttcgatcagttttattccgaaacggatcgactttactccctatatagaaggctggaagacgcgtacaaagtatacgttcaccacgtttttcataaataccttccggttcgtggtgccgaaaattgtcttctgcctcgtgtccagtacgcttgtcgcgtatggctttgcaaggtttgaatttccatttaagaagatctgtttttcgattttgatggctaccatgttccttccggccgtcgtgacaagaattccactctatattttgtggaagcagatgggactcctcaacacgtacgtgccgctgatcgcaccgaccatgtttgccaatgaacccttcttcgtgtttatgctgattcagttcatgcggtcgatccccacgtatctggacgaggcggctacaatcgacggctgtaattccttccagactctgatgagggttctgctgccgtccttaaaaccggcgctgatcagctgtacgatcttccagttcgtatggagcttcaatgatttccttgggccgctgatctatgtgaccagcctggagaagtatccggtggcgctggcgcttaaaatgtccatcgaccagagcagcggtatcgtggaatggaatcagattctcgccatgtcatttctggctctgctcccggccctgatcctgttcttctccgcacagaaatatttcgtggagggcgttacatcgactggagtgaaggggtgatcggatatggaacagaatgtccggctttctgtgacaccgctcatctcggaccatgcggtgctccagcgggatgaagtgattccggtgcacggcaggggaagagccggagccagggtgcgggcagagctgacgcctgagtgggtaaaggcagacggcgtgattcagccgaaatccggctggggagtggtgaacccggctggaacgtggctggtggagctgcctccgcttcccgcaggaggaccataccgtttgcaggttgaatccgaaggagaagaacaggagtttcatgatctttatttcggagatatctgggttatggcggggcagtccaatatgcagctgcccatggaacgggtcaaataccggtatcctgaagaatataaaaagggcgcatcacccatgatccgtcagtttgcggttccgattcagtggaaatttgactctgactctgacgcgctgtccggcggggagtggaagacggccgcggcggaacatactccggtattttctgccgtcggctttttctttgcgcagaagctgtatgagcgttaccatatcccggtcggcctgatcttaaccgcggtagggggaacacctgtacaggcgtggatgagccgggaggcgctcagcgattttcccgatgaacagaagaaactggatgcctgcagcgaccccgggtacgtggaacggatacggaaagaagatgaagcccgcattgccgcatggtggaggctgttggatgagagagatcaggggcttacggagaactgggccgcgggaggaggcaggcgcttctggaagaaaatcagccttgcggaccgctgggatgaccgtgaggacttaaaaggcgccggaaccgtctggcttcggaactgtgtggagattcctcccggtttagccggtcagccggtccgaatatcgctggggacaatcaccgatgcggactgcctctttgtaaatggggaaaagacaggaagcacctcctaccgatatccgccgagagagtatgagacgacggctctcaggccggggtgcagccggcttgtgctgcgtgttgcggccgtccatggacaggggggctttacgcgcggcaagagccatcggctgatctgggagaacggagaggagcgggacattaccgatggctgggaataccggcgaggagcggtgatggagccgttgagagaacagaccttttttgaacggaagccggcggggatgtaccaggggatgattgcccccctgcaccgtgtcccggtgaagggaatctgctggtatcagggagagatgaacgcggatgagtatgaacgctatcccgattattttaaaaggcttatcgaggactggaggcggaaatggaacagagccggtttaccggtactcttcgtacagcttcccagttatgatctggaggatgggaaaaactgggtacagttccgggaaatgcagcggaagctgacttcggttcccggtacggccatggtggtatcaatggactgcggagaggaaaatgacctgcatccggtgagcaaaaaacccgtgggagagcgcctggccatggcggcgtttcaaatggcatatggagaaaacggagtatggctgagcccgttgttttctcacggtgaaaggacagcggagggaatgattctgcatttcaatcactcggaaggcggtctggagacggttgacggaactgcgccgggcggatttgagtactgtttctatggaggagaagggaaagaagacggcaggaaggtaagaatgatgccggcagaggcacgaatcgaaggaaacacggtagtggttccgtggccgatgcgggacaggcttccggatgcgctcgtatattcctggtccaacaacccgtcaggagccaatctgtgcaattcagtaaagctgccggcctcccctttcctctgccagatagagacagagaagcgccattagcccataaaagcacaaaaaaagatgaaccggttaaaaaccgattcatcttttcgtgcaccgagtacggataaatccgaaccctcaacctccgccagtgtgatggtcttagaaccgtccttatagttgaaagtaaggattatcttgtcctcataaagatacaccgcatttacaaaactgtcaatcagtctttgccgctgttcccgctttgtcacatcaaatttgcggaatcggtaaatgaaaaatgctatctgttctcttgtaagcaggggcttgtgcatttcctcctgtaaaatgctgacttcaagttggcttttggtttcctccaactcgtctagtctttgcttggtggacggggtaaaaatccctgcttgaatggcgttgagcatattgttaatacctttttccgtttctgcaagctgctttttcaaaaggggcaggtcggtgctttctttcttctgcaactccatcagcgtatcaatcagccgttccatgacttcatcattcataattgctttcatggtatagttgacaaccaaatcttcaatccagtctttcttgactgctttcttgtcgcagagcttccttttcttggtattcacacagcgataataacggtgtactttcatcgtatggcttgtgccgctttctcccaccataaaggagccgcatttcccacagtacagcttcgttgtcaaaaggtaatcgtcctcggctttgtgacgggcaggagcctttttgttcttcgccagccgttcctgcacccgttcaaataattctttcggcacaatcgccggaataccgtcctccttgactacatcacgataactgtactcacccatatagcggcggtttttcaaaaggtggttcataatattcagcgtgattttcccgccacgaatggaacgcataccccgactattcaatagattaacaagctcctgcatggttgcaccctcactatatttcgtgaacatttccagcaccaccggggcagtcttggggtcgatttgataatactgttgttcgtcaatataatatcccatcggaacagtaccgccgttgtacttacatttcaacgcattgtcggtcagtccccggataaccttttcagagagttccgcagaatagtattccgcatatccctccaacatggcttccagaataattccctcgctgccctcggaaatattctcccttgcggaaatgactttcacgccattctttttcaaaaggtttttatatcgtgcgctgtcgtaacggttccgggcaaagcggtctaatttccatacaaggacaacatcaaataagccttttgcgctgtctttaatcatgtgttgaaattcggggcggttatctgtttttgctgacaatgcccggtcaatataagtccctaaaattgtaatatcgttgcgttctgcatactccttacattcccgcaactgtccctcaatactttcttctcgttggttatcagaggaataacgggcgtaaatcacacctttcattttttctccacctccatcatttcaagaagcgtctgttttaatttttcattcagcggagattgcggatcaaaacacatttcaataaactgcttcatttcctcactccccggcgcaatcttcggacggtattcatatagcttgccttgcggattgtctgtccgggcaagcaggtaatccaatgatacatcaaaataatccgcataccttacaagcgtttccaaagagggagccgactgcccctgctcataacggttgatactggactgcttcactcccaaaagttccgccatctttacctgcgacagcttcacactttcccgcaatctccgcaggcgttctcctaattctctcatgggctgtaacctccttgtttcctctatgcttagtatatcacttttacggttttctttcaacccgtattaagcatatttcaagggaatatattcgtacatcagataggggaaacgagggagggatacaacaaaataagcggtcaatccggctgtggttttacagtagattgtgaccgcttattttgcattttggaggaagtgtggctacacacgaccacaaaatagggtttccaaaggggcacccctttggcacacaactttgcttacaaagtgtagtgtgttatacgctctgtcggcgttgctgagaaaatggggttgccaaccgggagggcaaggacatttgaagcagcaggaaaacaaggctgtgattgtgtggcgtggagccgcaaacacagggttggtttcatcagcagacagggcgtatatgaaagcccctccctcgtcccacgccggacttcgggacaaaatgtcccgaacctgtggacacactcacaaaaagcagacagatttttctctcaaaattgaaatgggcgggaagccattttagggctttcccgccttgattgcccatcagcaaagacgggcgggactgtcaacggcggcgcatgaaatgcgccgttcatcttgaccgttgactggctcggctggctttgctatctcctcgataaatgggaatttttcttttttattcgtccaaagcgtcacaaagcttgtccataatttcagaaagagcagttggaattccttcttcccagtttggactttctaaaacttctccatctaaagccatatacatctctttaggtatctctcttttcatttcctcttcgtcaacttcttctgtccagtcataatctgaattatatggatcatttttagggtcaaaagcatatttttgatttttataatatcctgaaatataatttttttcaagagtttcaacaatatcaaaatcttctaaagcccagctgtcctcttcttcacattcttttctattttcatatttcttaaaaaattgaggattcatataccaatataggaatagagctgttcccttgtcagtatcaggctgttctgctatccatttgataacttccttagaattatcaaagttccaatctattgctaaaagttgtctttcttttggagagtttttctttaaataatttataattaactggttttctaactcatcaaattcattttcgtcaatctctacattttcccaatcaaaatcttctcttaaaatatcttcaatttttaacatcaaaatacctcctaaaattcatatttttatatttctttattagttctatcaactgaattttacttttcacctattgccttgaaacagaccactgcaccgcaaataaaaaatataatgcaaataatgagtgggattattaagtctaatcccaacaaactgcctaaaataccagtaattccgttataatcccactggtaaggtgccgcagagcatagaataattattgaaccaagaaaacccattagctgccacacaattcctaaaatcatttttttcatacaatcacattcctttatcaaattccgatttgctgttctcctacttccgcccccgttgtgggtttggatttttcagcaagtccgacttctgtgcaatcttcttcagccacttcttttcttcctcggacagcttcttcaaattcaatttgagccgcttacagataaacgccaaagctgcttgctccgggtcgctgtctgggctggcggtttcctcggcggtctgcaaaaaatcttccagcgggttgtcctccgggacgctgaaaaaatcgtccttatgtgcttcccgcaggtcaagagctatcttgtttatgtcctgctgtatcacatagcggcaaaagctgtcatcatcaatatgggcggcgataagctgtcttaactgcgggtcagacaagccgggattgtgctgcttcataatggttgcgctcacagcgtctacaatagcgtttgcactctgcacctgtttgccagcaataccgtttacatagatttcgaggtcagccatcagccgggggaaatccgggtgtaccgccagttcacacaagagggaattatctatccgcccacttttcaagagtacaatcatatcatcactcaaacgcaggtctgcaagatcggcgtttgggtgatttcttgtttgggacagccccagcagataatcggcggtcacgccgtaaaacttcgccagcttgataatggcatagtggctgatgtccttgaagtcctttgcttcataactgcccagtgcagacttggagagatttacttgttcttcaagctgctccagcgtcaacccacgctccacacgcaggtctttcaatcgttcttgtatggatagttccatgctccccctccttgtctacttgataaactggaagctataaatgtgatgtaattaactattcatcttcaatttcttctgcgtctgataaatcataaatgccggttaaagcttttccattaaagtttacagatacgccaaatggttcaccaacacccaacccattttcgagaaagacaatcgcccattcctgcttttcataaaagacaaactgagggcagtcaaagggcacatcttttagctttgacgcattttttccagtttcttttgacaaattaaaaagctccggttgtgtagccaatttaacccttatatgttcaagagctttttcttcatgatatttccaattttgaataatatctgctataaaatcaacatctgcaacatctaagttggaagaagccaatattatgtcaaaaccttgctcacagccagttatcgtaccatgccaacaatgaattgattgagggcttttcatgtggcataaatcgcctaattttgcgtgatgtatgatattcgccattctgtccctcttttcttcaacttccgttttgtcactctgtacttatcattttaccacaattccgagagcgtggaaatagagagttttccgggctgatttccgaccttatggatatacggggcaggcggtcttttaggtgtagacttagggtagttcatcgatgagctgcaccttgaaaaccgaatgaccgtccgaaaggataccccggcaggggaagcaccgcaaggaaccgacttcgggacaaaatgtcccgaagtccggggagcgtgccaacgctggaaatcctttcggggagaacggctaaggaaaaatggagggaacacatgagagagaacccatataaacgactgccgcccatagagcgcaggcaagacggttccctttaccgcatgacaacggcacagaggaaacaggcaaacgccctgatccgccgggagtgctgctgttatgaggacgggaactgtatgctccttgacgatggggatacccacaactgcccccagaccatttctttctcggtctgctgtaagtggttccgctggtcggtcttgccgcaaatcggaacgctggaagcagagattttccgggataaggagctaaaacgctgtgcggtctgcggcagaatgttcgtcccaaagtccaaccgggcgaaatactgtcccgactgcgccgccagagttcacaggcggcaaaaaacagaaagtgaacggaaaaggaggtcttatgtggacagttaggggctgaaaagtccttgatttacaaggctttgcaagcacagaacaggggcaggcaatagaaactaccgtctgcccccggaaacgggctcctaaccgtccacaaaacacgatatgacaaccaccatttatatccatcagccggaaaaagcggttagctttacccggcttcccaatttcctttttgaagcccccacattcacgccactgtccaacgaagcaaaggtgctgtattcctttatcctgcgccggacagacctgtcccggaaaaatggctgggcagatgaatatgggcggatttacctctactatcccatcaatgaggtagtggagctgctccgctgtgggcggcagaaagcggtcaacaccctgcgggaactgcaatatgccggactggtggagatccagaagcagggctgtggaaaacccaaccgcatttacccaaaatcctacgaagcggttccaaacaccgacttcaagaaatcccgttccggtacgccggaggactgaaaaccatactccacaagtacgataatcaatcctcttgaagtacgaaaaccggacggtatatagaaatacagagataaaaacgatttatttatatcttatccattcccttcctatccgagatattttctgcgggattttcctgtggaaaagtcccggaaaggaatggaatggggaaaggagtttcatggcacaacacgcaattttgcgatttgaaaaacacaagggcaatccggcaagaccgctggaagcccatcacgaacggcaaaaggaacagtacgccagcaatcccgacattgacatcagccggagcaagtacaatttccacattgttaagccggagagcaggtactaccacttcattaaaagccgcattgaacaggcaggctgccgtacccgtaaggacagcacccggtttgtggatacgctgattaccgccagccctgagtttttcaagaagaagtccccaaaggagatacaggcatttttccagcgggcggctgatttcttaatcggacgggtggggaaagaaaatatcgtgtcagcggtagttcacatggacgagaaaacgccccatctgcatttggtctttgtcccgctgacggaggacaaccgcctgtgtgcaaaagaaatcatcgggaacagagccaacctcacaaaatggcaggacgattttcacgcctatatggtggagaaatatcctgacttggagcgtggggagagtgccagcaagacaggcaggaagcatatccccacccgtctgttcaagcaggcggtcaatctctccaaacaggcaaaagccattgaagccacgctggacggcattaccccattcaatgccggaaagaagaaagaggaagccctctccctgctgaaaaagtggtttccgcagatggagaatttctccggtcagctcaaaaaatacaaggtcacgataaacgaccttttagcagaaaatgaacagttggaagccagagccaaagccagcgagcaaggcaagatgaaagatacgatggaacgggcaaagctggaaagcgagctaaaagacattcagcggttggtagaccgtatcccgccggaggtgctggcagaactgaagcggcagcagcggcacacaagggaacggtgatcgatgacagaaaacatttcacgccgcagcatggcggcattgtaccttgacaactgaatatgaagaaaggcgatatatggcaaaaaagcaaccggacacaaatatcccccagcatgaaatagaagcccttgctcggtgcttacttcccgaaatccaaaaattctttgaaagcccggaaggacaaaaagaatttgaagaatggaaagcacagagggcaaaggaaacagaaaaagaaaggagcgtatgacaaaagcggcggtatcgtaactgataccgccgcttttgctttagcactaaagatatactaaaaatccgaagccgtccccgattggaaccgggttcggattatcattatctggtgcgggagatgggacttgaacccacacgagaattcacccacaagatccttagtcttgcctgtctgccaattccagcactcccgcgcaacgaagactatgataccatttttaagaagaattgtcaacattttttgaaaaatatacacaaaaaaatattttctaaaatatgtaaaaatatgattgacaggaagccccttttataatataataactactgttgctgcgagagattgcagagacatgcagaagtggcggaattggcagacgcgcacggttcaggtccgtgtggtagcaataccgtgagggttcaagtcccttcttctgcatcagaagcccctgtagactgagtgtctgcagggctttttttttacgtaacaggaacttgctcctattatataaaaagccgggcaggaggcgcacttcgcgccaaggaaatatggctgctgaagcagataacgattggaggtatggcatatgccgtgtgaaatagaaaacagtgtcctttcctttcggagggaaaaacgttcggtcctttacaggatcttaagtgttccagtttctataattgctattttggctgtatatgcctttcaaataccaaatcccatgatgcttctcatcattccggttgtattttttacatatctggaggggtatgtcagcggcggcttgagcgggctgactgcggatgtatttcctgaagacattgagttatgcaagaaggccgggatgaacggccatgttgccaaacctgtaaatgcagcagaattaattcaaacattgaaacggtatatccctgtacggcagtaaggagccgccgagaacgccaaaaggcgttctttttttgtttcacaggaaattttgtcctgtgatccaaaacaactcagggggacagcgcacccggcagaggaagagtataaagggatgggcggataaaatctaaaaaaataacaccaatctaaaatccggctactatcagccgggtttttctttttttataatgaatgtacggatacgaaaagggagcattcaaagggataaaaggaggaaggatgaagtgggatatcagtttgtgaatcaggaaggcgacttcgtgttggcggaaccggagcaaagtaccggtctctatctgccgttggtaaatccggccggagtcatgggggccattacaccaaccggccatggggacagcaagttatcacaggatcagttcctgctggaaccggctggtgcagaagatctgcacagccaggcgccggccaggaacttctggtgtctgacagaagggcacggcccctggtccgtgttcggtcagtctgcggaacaggaggcgcggcgtttcagcggacacaaagacctcagcgaactggaggcaggcgccttctggcagaaagtgaaacgaaaatgcccggacagcgggctggcggcggaagtactttctttctgtcctgtagatgattctgaagcagccggtgcccgggcagaggtgatgaaggtcacactgaaaaatgaaggaagcagggagctcacggttcgtccggtggcggcggtcagcctctacgggcgcggagccgaccacatcagagatcaccgccatgtgacctctctgttaaatcgtatgacggtcacggctgacgggattgtgctgaagccatccatggcttttgatgagcgggggcatcatcaaaatgagatgagctacggcgtgttcggaaggcgggaggatggagcgcggcctgacggctttatccccgtgtcagcggattttatgggcgaaggcggaagccttttatggccccgtgcgcttgctgatgaaaagatgtccgatcatgaggtctggaagaaaccgggttacagtacggagggatacgaatgcgcaggcgttatacggtttgaagagatgacgctgaagccgggggcgtcatgcagcttttatctggtgctcagctatatggaagagggaaaggagtacctggagaaggaaaaggcggaagccgcgtttgagtcgatgaagcggtattggaatatgcagaaaatcgcagggtgcagtacggggaatcagacttttgaccggtggatgcagtgggtatccctgcagcctgaattaagaagaatctacggctgttctttcctgcctcatcacgattacggaaggggcgggagaggctggagggatctgtggcaggactgcctcgccctgatccttaagaatcccgccgccgtgagggaagatatggcggcatttttcgccggaatcagaccggatggcagcaatgccaccatcatcggaagcggcagggggactttcaaggccgaccgaaacgcaattgtgagaatgtggatggaccatggctactggccttaccggacggtgcgcctctatctggacgcgacgggggatgtcgagttcctgtttgagaagaatacctattttgtggacggagtcagaaccagagcaggaggccgggagaaggggagtgcgggagaggaaggcagagaagcgtatcggggaacgcttctggaacacttgctggttcagcatctgacccagttttatgacgtgggactccacggccatatgcggctgcgaggcgcagactggaacgacgccctcgacatggcgggggaaaatggggaaagtgtggccttcacagcggcctacagcggtaatttaagagaattggcggaactgatcacctggctcagagaggaaaaaggcgtagctgcggtggaagtggcggaagaactggggacactgctttgtgcggacagggaactgtatgacaggccgcatggaaagcaggaattgctgggagcctactgtgaacgctgtcttcatggcttcggcggcggaaccgtgacggtcgatacgggacggctgtccggaattctcgatgccatgggagcgtggatccagcagcacatccgtctcacggagaccataaaggacggggaagataacctctggtttaacggatactacgacaatcacggtatgcaggcggagggcgtatttgaagaaaacgtgagaatgatgctgaccagtcaggtcttctccatactctcgggaaccgcaaccgacgagcaggtggagcggatcgtcggcgcggcggaccgctatctgtatgaaaaaagcgcgggcggctaccggctgaataccgattttaaggaagtaaagctggatctgggacgaatgttcggtttcgcctatggccataaggaaaatggagctgttttctgccatatggcggtgatgtacgcttatgccctgtaccggaggaaatttgccagagaggggcaccgggtaatcaaaagcctttacgggcagtgcatggattttgcggcctccaggctctatcccggcattccggagtatttcaatgagaggggcaggggaatgtatccctggcttacgggggcgggaagctggcttatcctgaccctcctgacccaggtcttcggcgcagaaggggagtacgggaatctgacgcttcatccgcagcttctggctgaacagtttgaccgggagggaaatgcccggattgcattttcctttgcaggcaggaagatgaatctgatttaccagaatccgaaacacctggaggtgggcgactacgaggtggtggagatctgcctggacggcaggccgctgccatttgataaaaagaacccggtggtttcccgggaaacactgctgcggcttcctggtgaccccgtacatactctgcgagtcacgctggaatgatactgttttttaagagaggaaggaatatccatgttagataaaaataaaaactatgttatagaaaactaccatttaaaatcggccttttccagctttttgccggggatcagcggggagcacggaattcccctgtggtgctattacgtgaatcggggccagtgtgtctcctgctttgggattcaggataaggaccatcccattatggaattttatccggctcaccaggcgtatgagaggacgccgcttctgggctttcgtacctttttgagagtgaacggagcgtatgaggaaccattttccgggagagacagggcgcggcgcatggtgatcggcatgaacagcctgacgattgaggaggagaccgggcagtaccggatttcggcagaatatgaaacgctcccccaggagcctgtggcggctctgatgagagaggtgaaaatcacgaatgtgacaggcgaagacctggcagtcgaggcggcggacggcatggccgaggtgatcccctgcggcgtgagcagcaccaccatgaaggatatgggacagacggcaaaggcgtggatggaggtaagggatgtccgaaacggtgtgccgaaattcagagtgagagccagtatggaggacagtgccgaggtgacggaagcagaagggatgaattttgcctttgcccggggcggcgaaggggagattctgcctgtcattgtggaccgggagcttctgtttgagacggatacggcgcttctgcgggcctggggatttgagcgggaaggcgtcagactgcccgatcataaggagcaggttacatgcaacgataccccgtgcagcttctttctcgcttcccgcatcctgaaacccggagagacgctggtgatgcgggagctgtatggaacggcgaaggaacagacccgcatcgaccgggtatggaagctgtccggagaggacggatggtttctgggaaaacagagggaggcgttcgctctcacggagcagatcacatccaggattgcggtaaagacgggccatgcggtatttgacgcatactgccgccaggattatttagacaatctcttaaggggcgggtacccggtgcgcatcggaagcagtaagaccttttacctctattcgagaaaacacggcgatatggagcgggattataatttctttaccatgctgcctgagccgtatacccagggaaacggcaatttccgcgatgtctgccagaaccgcagatgtgacgtctatttttcaccgtttgtcggggacagcagcattcggaccttctacaacgcgctgcagttaaatggatacaatccgctgggaatcgaaaaagtcacctatacgatgccggaggggcaaatgccggttctggaaggggtggaggcggccgcggcagatgcgcttaaggacctttttacaaaagagtttacaccgggacagctggatgaaattctggcagaaggggtggaagagagggcggaccgggagcgtattttcgccggcatcatggatctggcccggagtgaggaccggaccaggtacggggagggctactggtgtgaccactggacctataacctggatctggtggaggcgtatctggccgtctatccggaacgccggaaagcgcttctgtttgaggaggacggctacagctaccgtcaggcggaaaaacgcatccttccccgcaggaaacggtacgttaagacggaacaggggatcaggcagtaccatttccttgaggacaacgcggacactgaaaggaaggaaaaccggtatttgaaggatcaaaacggctgtgtggtgacggctagtctggcctccaagatgatgacgcttgtgattacccgcatggcggcgctggacccgtacggcatgggactggagatggaaggcggcaagccgggctggtatgatgcgctcaacggcctgccggggcttttgggctcctccatggcggaaacatacgagctgctgcgctgtgctgcgttcctgatcgaatcgctggagaaaacagaaaaatccatgatactgctgaaggagacggccggtctcgcaggcgcggtctgcagagccggacagcagttccataaggaactggcggaagggacctctgcggccggcttctggaatgcggtgaatgatgcgaaggagcatttctgggataccacttccagggaggtatcgggggagcgcgtgacatgggaagcgcaggagaccgtccgcgtgctgacgcagttttccgatatcctccgtatgggaatcaggaaggcggccagactgggaagaactgtgcggcctacctatttttactatgaggtgacggagtggaaggaggagccggatggaatccttccgcaggcattccgggtccataatacgccggattttctggagggatcggtgcactatatgaaaattgcggcggatgaagaggagaggaaggcggtttatgagagtgtccgcgcaagcaggctgtacgatgatgcgctttcgatgtacaaggtaaacgcgtcgctctccgaggcgaccttcgagctggggcgggcctgtgcatttaccccgggatggctggagaatgagtctgtctggctgcatatggagtataaataccttctggagctgctgaaggccggaatgtatcaggagtttacagaagacttccacaaggccgcggtaccgtttcttaatgaggaacagtacgggagaagcctgcttgaaaattcttcctttatcgccagcagcgccaatcccaatccgcgataccatggaaaaggctttgtggcaaggctcagcggcggggcggccgagttcctggagatgtgggagatcatgatgtttggaaaacagccgttttccgtcagggatggaaagctggagctgtcgtttgaaccgtgtttcccggaatatctgacagggaaggggaagacgattacggcgacatttctgggaagcgttcccgtcacctacaaactgccggagcagagagcggtccttccgggcacttacacggtggaacaaatcaccgtagagacggagcagggggaggagtccttctcccggactgtgacagggccggcggcagagatggtgcgggagggacgtgttcgctccatcacggtttcgctggcagggaagctctgaagataaatgaaaatgaatgaaaaataaaaaaatgacacctgagaaaaatttgagacattatgcgcttctgatgcggcagatataataaggctatcagcattcagaagtgaaaaacatagtccgaaaggacggcagacgaagaggaggatttgatttatgaagttaaaaagggcagtggcagcggtaatggcaggactcatggcgtgttccatgacagcgtgcggatcggggaattccggcggcgggaacacgggtggagagacaggcacggaagccgggaaggaagctccggcaaaggcgggaaatgaaacagccgataaaaagctggtggtgtggaccctggcagaggacttaaaggagttcgccggcaaatactgcgagaccaatccggatgtacagatcgagacagttacgattgcaccggccgattatccgacaaaggtccagacggccatgcgcggaaagcagacgacgcctgatatcatcgtgggagaaccgcagatgcttcaggatatgtatgaagcgggttacttcgaggatttaaaccaggctccctacaatgcccaggattacgcggataagattgtggattacgtatggaaggtaggccaggactccgagggcattcagagagccatttcctaccagattaccccgtgcggaatttattacagacaggatatcgctgagaaggttttcggaacggatgatccggaggagatcgggaagctgtttcaggattacgacaccatccttcagactggccagactttaaaagacgcaggctataagatctttgcctccgacggcgagatgaactttttctccggagacagcacctgggtgaaggacggtaagctgatcgtggaccagcagcggaaggattacatgaacctctgcgtgaatttatatcagaatgatatgacggcgtacgtagattcctggtccgcaacctggtatcaggcgatgggcggagcggttccggttatcgcaaagggaaccaatgtctgggatgagacggcggttcaggaggcggcagaggcaagcggccagatgacggagatctttgcttacggcctgccggcctggggtgtgggaaccatgcgcgatcacgtgggcgagctgtccggcaagtggaaggtctgccagggacctgcctacgggttcagcggcggtacctttatcggaatcagcaccttcagtaaaaataaggatctggcatgggattttatcaagttctgtacactgacggaagagactctcgactggtgggtagaggcgtcacagggcgatgtggtttcctatctgccgtgcctggaaaagcataagaacgacgaaaatgaagtatacggcggtgagaagctgtatgagttcttcttgaagcaggcggagggaatcgactattccagagtcacgaaatacgataaaaaggtgggagatgcgtgggcggcggcaatcaattccattaagatgggagagatgtcggaggaggacgcggtcaataacttttacgatgtggtggcttccacgtatccggaacttgagattgagcgctgattaagcggcaggaggagagactatggcaggaaaagccttggagggcggaagaaagaaaagcgtggaccggacaggatacttttttgtcgccccgtttgtgatcgtatttttcatatttaatgtctatcccgtagttcgtactttttacttaagctttaccgattacaagggcttcggtgatgcgatgtttacgggcggcaccaattatctgcgcgttcttcaggataaatttttctggaaggcgctgggcaacaccgcgagaatctggagcgtcaacatcgtgctccaactgggcctggcgctggcgcttacaatcgcgtttagcgatattaaatataagatcaggggcctggcggtcttccgtgcattatattaccttccgaatctgattgcggccacatcggttgcgtttctgttcaagacactcttagactggcgttacggcactttaaatcagcttctcgtcggagcggggattaccgccgatccgataaactggctgggctccacggccacggcgccctacgtgctctcagtgatcggcgcctggatgtggttcggcaactccttcattatgctgatggcgggagtgcagggaatctccagggattactttgaagccgcggcgatcgacggtgccggaaggatgaagacatttacaaagatcacccttccgctgctgaagccgattctgctctatgtggggattacatccttaatcggcgggctccagatgttcgatttaccattcctgatctgcggcggcacggcgggaaatcctggcggaagcacacagacggtcgttatgtatctgtataagttcggatttgagacgaatcaggttggctttgcctcggcggttgcatacgtcctgttcatcatcattctgctgttttctgttctgcagtttcaaatgatgtatggaaagaaaaaggaggggaataagagatgacagcgaaaataaaaaaaggccttctttacgcgattctgattttcctggccgtgatctgtctgatgccgttcctgcttatgatggttaatgcaacccgcacgggatcggagatcgtcaaatccttcaccctggtgcccggacacgcgctgtccgtgaactgggcgatcgtatccagctacttcaatttattcaaggggatggccaacagccttttggtagcgcttccggccacgctcttcacctcgtatttctcggccatggcggcgtacgccctcgtcatgtataagtttaagggaaataagctcttaagcggtgtgatcatcatattcatgatgataccggggcagctgagcctgatcggcttctatgatctgattacggggcttcgcatgatcgatacatactggccgctgatccttccggcgatcgcttcccccggaaccgtgtttttcctgagacagtactgcgaaggctccctccagccggcgttaatcgaggcggccagaatcgacggggcgaaggagctgcacatttttcacaagattattttaccgctcatgtcgccgggaattgcgaccatggcgatcggagcgtttatcggcaactggaacagttatctgctgcctttgatcctgctgaattctccggataagtttacgctgccggtcatgatcgcctccctgaattcctcgaaggatatcgcgtcgaaccagggcgctatttacctggcagtggcaatctctgtcataccgatcctgatcgtatttgcattctgctcaaaatacatcatcggaagcctttccgcaggaggcgtgaaagagtagattttccataatcctgcggacagaaccgctgcgtccatggtataatggaggcagcggcttttggccgttttacttggtgagagactgctgccggtgaggcagattggaattgagaggagccgttttatgggaaagagaagtataaacggcagaacgaagggagcgctgtgcctggttctgctgattctgggatgcgcggtgagcggatgccggtccggacaggtccgggaaccgtttccgccgtcttcggaagagccggggacagaacccggtgtcgtggatttaaactggtacatcaactactcctggtttgcaacggtctggggcgacagtgaggttgccagagcgattacggatgccacgggagtgagcgttcattatcagaccccgaagggcgatgagagcgagaaaatggatgccatgatcgccgccgacacgctcccggatctggttactctgggatggtcggaaaaacagaactatgatatgatcgagaaaggacaggtctgggcgctaaacgagctggcggatcagtatgatcccgctttttacggggagctggatgagaatgtggtaagctggtacaagcagcctgacggaaatctgtacggctatcccaactccttttacacgccggaggattaccggacggagaaaatctcgtccaaccagaatttcatggtgagaaaggatatctacgaggcgatcggaagcccggatatgtcaacgccggaaggcttctgcgacgcggtccgcaaggcggcgtcacagtttccggaggtggatggagaaccgctgatccccataggggcggaggaatttaccagcgagggctgtaattccttcggtccctatctccagtcctttctggcggttccgtacgaaaagtccggcaggtattacgacaggaatacggacccggattttctgcaatggctgaaggttttccggcagttgggggaggaaggctatttaaaagatgagatctttatcgacaggcgggcgcagatcaatgaaaagctggcgaaggggcagtatttctgcctgtttttccaggcctcggatatcatgaatcagcagaggatgctctcggagcggaatccggacagcgtgtacatggcggtgaaaggccctgctaactccaggggagatgatccggagcttccggtcagcggaatctatggatggacggtgacgtatatatcgaaaaactgtaagaacccggagaaggcactggagctgcttcagtacttaatcagcgaggaagggcagaagatggtctgcctgggcgttgagggaaccatgtatgacatggtggatggaaaggcgtgcacgaagccggaggtaaaggagctgctctactctgaccgaaaggcctatgacgagcggtacggcgccgacaacacgtactggatgctgcaaaacaatgcggttcagagccagtggaaggaggagtcggattacgcaatccgccagctggaggaatggacgtatccctatacggtctataccgcccagtacagtattcattttggcagcgacagagagggcatggatcttcataaaaggcagcagaagatatggggagagacactgccgaagctgctgctttcggaggacgaggcggagtttgaccgtattctgaacgactatctgcaggtccgtgacaggaatgactacgacggctatacggcgaaattggatgcgctttacaacaagaacaaggagaagctgggaattgaggatgaagaaggctttcagaaatcttaaactgaatcagaaattcacgctggcggtcatggtgatcgtcgttgtaccgatgattgctttttccatttttctgtattggaatatatccgggaatatcatctggcaggcgaagacagagaacgcaaaccgggtgaaggaaaattacagtaatatgcagagtatcattgaattttccaatatgtccgttcagtcctttataaacaatcaggggcttaaggatatgctggtccgcctgaaaaatgatgaagtgatttcggcaaaggattatctggagtttgacagaaatgacattgccatgctggaacgtctggtcaacagcaatccttacttatatcaggtgcgggtgtatgcttacaacgacggtttcccggagatgatgccggttctttaccatggcagcaggcttttggaggtgccgtggggagagaactatgagccggggaaatggcagattgattatcccgacaccgttatgaaggattttgcagtgaatacctcggatcatctgatggccctcgttcaggaggtgacggatgattatgggaatcccatcggcgtggtggaggccgcagtctccatggatacgttttttccggagctgtacgaggcgaaggccggaagctgggcttgctttgtgtctgcggacggaaaggtgcatgacaacggcactgacggacaggagtggcagcctgatgaggaggtgctggaagcagtcttaaagggggaggcctccggaaaaggcttcctggccgagtatgtaaaagcaggcggagatgacatgatcgtggtctgtcagcccgtgaaggagctttccggaacctatatacagattaccagcatgaagacggagatgaaccggctgtcgagacagcggaatctgctgatcgccgtactgctggtgattttcgtgtgcctggcctttgcggtaaacggcgtggtgaaggcactcttaaaaaagttttatgagatgctttccgtggtgcgcaaagtccaggagggcgatttggagcagcgtgtttacgaaccgggaagagacgagatgggagagatgagcacgcagtttaataagatgctggaccggatttctgtcctgatggcggagaacgtgaaccgcgaggtgctgatcaagaacacggagatcaaggcgctccagaatcagatcaatgcgcatttcatctacaatgtgctggaggcggtaaaaatgatggcggaaatcaaggaagagtatgagatatcggattcggtgaccgcgctcggtgaactgctccggtacgggatgaaatggacctccagtgatgtgaccatccgccaggaaatggagtatattaagaattatatccagctcatgaacctccggtatgattttgcgatcctgctctcgatccggatcccggattatatctatgagcagcaggtccccaagatgtcgctccagccgatcgtggaaaatgcgattatccatgggatcgaggagacggaaaacgatgcgaccatctacatcaaggcggtttgccgcgatgaagactatgagattgagattaccgattccgggcagggaatggacgaaaatcaggtggagctgctgaaaaagaaggtcagcggcgagatcgaggtgagcggaggctccggcaatggtatcggcttaaaaaatgtgcaggacagaattcacatacggttcggggaaagcttcggacttcattttgcatcgaaggaagggtgctttaccaaggtaagcatccgtcttccctatacacacagggaggctgaaggaaatttaaacggcagtcatgagaatgggttatttcatgaacggtaatggagggatagcagatgagaacgctgttgattgtggaagatgagaagatgatacgtcagggaattgctgtcatggcgaagcgcagcagtgtggagatatcggagattctggagtgcagaaatgggcaggaagcgcttgagatcctgaaaaaccgtgagatagacgtcatgtttaccgatatccggatgccgaaaatggatgggattgaactggtaaaggagacggagaatttaaaaaagtgtccgaagatcgtcgtggtaagcggatacgacgacttcaattatgcggtggagatgctgaagcacggggtgaaggactacatcttaaaacctgtaaaacgcgagaagattgaagaacttttaaagaagctggatgcagagattaatggggagaggaggctggaaggaatcgagcttcaggcatttgccagggagcttaagctctatttgaagcagccgtctgttctggagaaggaactggaatcggtgcggtggaagtttgaacagtatatgggacaggagccttattatgcggtggtgagcgccaggcggagggaagaagaggaaaaagagccggagccgggctgtctggaactggagatggacggacaggaaatccgctttttacaggcagcacattcggaagcgtttctacagaatgccggactggcaggtgctgtgggcgtaagcggggaacaccgctcctttgaagcgtgcagggatgcttaccgtgaggcggcagaggccaggctttacgcgtatttccggggactttcccggtgctgtccggcggacatggcagccggaaaagacggggagaacgtgccggaagagttcgtctctcatttcgtgagccagtttccgacggagcatatggaaaaggcggtgctctcttttaagcatctgctttttcaggcgcggcacggccaattggccatggcggatgtgatagaatcggcggacaggcttcagagggagctgagcgggtcttacaggaagatggtaagcgaagagaagcagccgctgtttgacatggagccgcctctggccttcttgaacgcggaggagtacgaggagtgcttctgcacctgggtcagacagatccgcagctgtatggacgaagtatatgacagcaatcagaaccggaacaagatcagaaccgcggtgcgctacctggaggaaaacttccggacggacttaaatatggccatggtatcgaattacgtgtcgatgaactattcgctgttctcgatcgcatttaaggaatacacaggcgttaattttgtgagctacttaaaaaatctcaggattgaggaggcgaagcgtctcctggaaacgaccgatgagaaggtacaggatatcggacggagagtgggatttgagagcgataagcattttttgaagtcatttaaatcgatctgcggcatatcaccgaccgattaccggagaaatgcggaacttgggaaatagtggaatagcagccggaacagagaaaaaattaaaattaaaattgtaaaacatattgacattttctccatttattggtattatgatatggctgtgcgggagtgctggaattggcagacaggcaagactaaggatcttgtgggtgaatgctcgtgtgggttcaagtcccatctcccgcatgataagagcgaaggctcaggtgaggattttgtgaaaggtgaaagccttttatgaaatccttttttcgatttaccggtacagcggtatgcagcagggaaaggacagtttgatggacagggtgaagggaaatggatcatttggtgataaggtacgcaggacgtggctctcgcttcctctgcgcaaaaaggtgggcgcaattacggtgctcgccgcatttgcggtgtcattttcgatcctgatgaaccttgtgaccgcgggattcggcatgaacgggttccggaagatcctggaggacaattcccgcagcgcttcctttcaggcggcgatggagacggagagccggacgtttaagaccatgatccgggaccgttcagaggataacagagccgcttacgaagaggcgtgcggtgcggcgagaaaggccctggaggctctgccgtacgattacgacgagatcgggcgggaacgtttcgcaaagacgtggtccgtgaagaacagctacgatacgtatgagaagaggaaggccgagctgctttcgatgtctgaggatgaccctgagtacgttcagaagctgtatgagatctatcagatacagaactacatcaagagctacgccggaagccttcaggagatgaatgtggctgcgggaatccggagatatgaaaagcagattccgctgtttctcctgattccggcgctgacgattctttggggatcgcttgcgctggccgccgtcctatggctgaaccggtcggttggcagacacattgtcaggccggtgcaggcgctggcggaggattccagacggatcgcggaaaatgattacagcggtcctcccgtttcaacggaatgtgaagatgagattgcggatctcgtccgggcgttctgccggatgaaatgttccacacagggatatatcgagacgctgaaagagaagcatgaggtcgagacgcagctggaggcggtccggcttcagatgttaaagaaccagatcaatccccattttctgttcaatacgttaaataccattgccggagctgcggagatggaggaggcggagacgacagagaagatgatacaggccatgagcaggctgttccgctacaatttaaaatcgacggcgtccgtgatgccctttgagcgggaaaagaaggtggtggaggattacatttatcttcagaagatgcggtttggcagcaggatccggtatacctcggactgcagccaggataccatggaggccatgattccggtatttgccttacagccgctggtggagaatgccattgtccacggccttgcggtaaagccggaaggcggacggctccatatccggtcctggataaggggaaaacgaatctttatttccgtatccgacaccggagccgggattgcgccggagcggcttgcagaaatccgggaagagctgagaaacggtgagagccagaagctgggaatcggagtcagcaatatcagccggcggattaagaccatgtatcccggcggagaactgctgatcgacagcagagaagggcggggaaccgtcgtgcgcatggcgtttactgtggctgagatgtaggggattatggtatgcggggatacagagatacaaagatatagaaatatagagatacagaaacagaggccagaaaacaaaggggaaagcggggaaagagccatgtaccgggttttgattgcagatgatgaagaaatagagaggctgtccttcagcaggaagctcaaaaagtattttggagagagctgtgaggtctttcatgcggaaaacggcatgcaggcgatcctggcggtggataagaacgacacgcccattgtgatcatggatattggaatgccggggatgaacggcgtggaggcggcggagtggatcagaaagagccatccggactgcgttatcatctttttaaccgcgtatgacgatttttcctatgcaaagcgggcagtttccctccatgcgctggaataccttttaaagccgtgtgatgacgaggagctcatcccggtgatggaggaagccatgcgccaggtggatctatgccggataaaggcagaaagcccggcaggcggagcaggctttgcggggagcggtttagctgctgccgggggaggaggcagaggcagggaaagcggcagaggcagggaagacggcagagacggagaaggcggcagagacggggaaggcatccgcggtaccgatgccggaaccagccgggacgcggaggacgaccccgagcaggaaccggagaacgggtactcaagagtagccgccgccatccgcgcctatgtcagggagaactacagccgcgatatttccatgcaggacgcggcgcgcgccatgaactattcagaggtatatttctgccgcctgtttaagcagtgtttcgatcagaattttaccgcgtatctgacccatttaagggtgaaggaggcgaaaaaactgctggaggacccacgggccaatattaaggacgtgagcagaagcgtgggttacagcgattcgaaatatttctcaaaaatctttaagcggatcacaggtcagctgccgtcggaatatcgggacggtcttccgtcatagaaataaaacacgccctaatactggaaaattgggtaatattaccctccttaatgtcaatattttactgtacacatttaatctccatggctttataatgttactgttaagaaaatgtcaagatcttaacgatttcgtaacacaaaagcagccatggagattttttgtttcatgggaaggctttccggcgcgcgagtccggcttgccagactctttgccggctgtttttgctgccggagagtattccggccgtttcgaagtatatacataccttggaacggggataaatagtatgtgaactatgtaatgtatgagaaggaaaggaatggagagcattgaaaaaaatgattaaaaaagcagccgctgttttaatggccgcggccatggcggtatccttgaccggctgtggttccatcacttcaggaaaacggattatccgtatttcccacgcacagtcagagacccatccggagcatctgggactactggcctttaaggaatacgtggaggaacggctgggggataagtatgaggtacagatattcccgaatgagattcttggttccgcccagaaggcgatcgagctgacacagacgggagccatcgattttgttgtggcaggaaccgccaacttagagacgtttgcagatgtctacgaaattttcagcatgccgtatctgtttgattcggaagatgtatataaaactgtcatggaagactccgactacatggaacaggtttacgagtccactgacgaggcaggattccgcgtcgttacctggtataatgcgggtacgagaaacttctatgcaaaaacgccgattcgttctccggaagacttaaagggaaagaaaatcagagtacagcagagcccggccagcgtttccatggtcaactcctttggagcggcggcggcgcccatgggcttcggcgaggtctataccgcgattcagcagggcgtgattgacggcgcggagaacaacgagctggccctgacgaataacaaacacggtgaggttgcaaaatactacagctacaacaagcatcagatggtaccggacatgctggttgccaacttaaagtttttagagggactgagcccggaagagtatcagatctttaaggatgcggcagcactttccacggaagtggagatgaaggaatgggacaagagcatcgaggaggcgaagaagatcgccacagaagacatgggcgtggaattcatcgacgtcgatgtggatgcctttaaggaaaaagtacttccgctccatgagaagatgctgaatgacaatccgaaaatcggtgatttttacaagcacattcagaccgttaatgaacaggcgaaaggggaagagtaagaatggaagcactgcataaaatcagagaagtcctgatgaagattctgggactgttcattattttcctgtttgccatgatgacgatcatcggcacataccagattgttacgagatacttttttaaccggccaagcactgtgtcggaggagcttctgacgtattccttcacctggatggctctgctcgcctccgcttatgtgtttggaaaacgggaccatatgagaatgggcttcctggccgataaaataacgggaactcccagaaaggtactggagacagccatcgattttctgacctttgcgtttgcggcagtcgtcatggtttacggaggaatctccatcacgaagctgaccatgatccagacgacggcctcccttcaggttcccatgggatacatctacatgatcgttccggtgacaggaattctgattatgttttttagctttaccaatgccatggacatgctgcatggcgatttcagtgagaagggagaggcgagagtatgaatatagcggttgcatgcggactgattatcctggtcctcttagtgattatgctgctggccggcgtaccgatcgcggtggctctggcggtttcctctatctgtgcgattttgccggttctcaatacgggagcggcggtacttacgggagcacagcgtatcttttcaggaatctcagtgttcagccttctcgccattccgttctttatcctggcgggaaatatcatgaacaaaggcggaatcgcgatccgtctcattaattttgcaaaactgtttaccggaagaattccgggagcgctggctcataccaatgcggttgccaacatgctgttcggagcgatatccggttccggtaccgcggcggcctccgccatgggttccatcatcggaccgatcgaggaggaagagggatacgaccgtgatttctcggcggcggccaatattgcgacggcgcctaccggcctgctcattcctcccagcaacgttatgattaccttctccttagtcagcggcggaacctccgttgcagcgcttttcatggcgggctatatccccggcatcctgtggggccttgcctgtatggccgttattttctattttgcgaaaaaacgcggctaccgcagcaccagacggtattccatgagtgagaaagtgaaagtatttttccaggcgattccctgtctgctcatgatcatcatcgtaatcggcggtattatctccggtatttttacggcgacagagggaagtgtggttgcggtggtatacagcctgatcctgtccctgttcttctataagtccattaagatttcggagctgcctaagatattcttagacagcgcggagatgacgggtatcatcatcttcttaatcggtgtctccagcatcatgagctgggtcatggcctttaccgggattccaacggccgtttcagaggccatgttaagcatcagcgataaccgttacgtcattctctttatcatcaatatccttctgctgattatcggtacattcatggatatgacaccggcctgtctgatctttacgccgatcttccttccgatctgccagaagctggggatgaataccgtacatttcggcatcatgatgatctttaacttatgtatcggaaccatcacgcctccggtcggtacgaccctgttcgtaggtgtaaaggtgggtaagacgaagattgaaaatgtcattaaaccgcttcttctttactttgcggccattttcatcgtccttctgctggtcagctacgtgccgattctgtcgctgtggctgccgggattactgggttacgtataacaaaattgaattatttttaaaaaattgaaaaaagtacttgattattttggataaatatagtaatataattgtatgaattggacaaccaattcgtacaattatatgctgtatagcaatgcagaagtggcggaattggcagacgcgcacggttcaggtccgtgtggtagcaataccgtgagggttcaagtcccttcttctgcactaaatggcgcgaagccgaacccggtgtactttttcaagaaagtgttcgccgtggtggtaaacttcacgcgcaaatagtgaaaaataaaagcgtcagggcttaggctctggcgcttttgttatgcccggtcgtctctcgatagggctcgagaaatagagcctgctcagctcggcagctatcaccgttcctctctggcctcctcggccgcgtggctattgtttacgggttgcacgggactggctgcggcgcctgctgccttcttgtctcgttttaaggttttcgcattaaaaaccagcaaaacttgtcagctatcactcagaccgggcttgatctgttcattatgcgcacccctctgaattttcacgggcttgggaccgtcctcggcttcattagtgccccgcattgctgcgggtgttatctttcccccatatctttgtatatgaggtcggttatgtatgagttcgtactctggtagccttttgacttggcccatgctgcgatccggtccttgtctccgatcggcaccgtgatcgggatccggtccttgttttcccgctgccatgtgttcttgtacttggtgtgggctgctgccagttcctccggtgtctttgtcgcttttcttgccactgtatcgcctccttcagagtaattttatcatatcatgcacacgacaacaacccgctacgctggcaatatgtcgatgtagtacgttttgcagacgcctttgtcgcatgagtcgccgatcctccagtttttacaccggaggagctcaggaacctgccagaggtagccctcgaatatatcgacgcggatcttgtgcccgaccgtcaggtatatgcggtcgtgatccgttttggtgttgaactccttaaaaattcggtactctgtttcttttgcttttttggttcctctcattggttggctcctttctgggcggcaatgccgccgccctttgcattattggtaaaacggtctgagattatcgtcttgaagttcgtagctcatacacccgcagtcaaatcgtatatagttccagtctgttgcgttgtatataggggagcggttggtttccccgatttttctgagtcgcccatgtctgtttacttcgtagattggagtcgtccggtgtatagttattttttctttagcgaagccgtaccattcgtaaagcaggctttttgcttcatcgtcggtcagttcctttgttccggctgcctttgcgagcttatcataatcgcattggctcacattttcggcgtcgttgtatggtttccattcttgttcgcgttctaaatctttttttaatttttcgatttcttcttgcgcggctttgattttttcagaagcctcgctgtcggatttcaggcgctccagattagcctcgtgctggatcttttcagctataaacccttcgtttttcttgtacgcctcgcaaaactcgtctttgtctccatcgaaattcatgtaaaatttttcgattgtcttgtattcttccgttgtcggaaaatagccggttcttttttcaaattcttttatttccatgagctgcctccttgttttttgcggttttccttgtttctgatattataatactatatcgtacacaagataacaatacacacactcaccaaacctctgccggagcttttgtctatcttgcacaagatattaaaacaatagagagcagcgtctaaaatgccccagaacgcaaaaaaggcgcccactcgataaaattaccgggtgagcgtctttgtgtcaattctgaccgtctgtggcttattctgtggccgtttccgtggctttggcagcctttacctcagcggtagcctgagcgactgccgtctgggctactgtggcagctaccgaggcggcagcggtggcagcagtagtggcgatctgtgtctgcttttcctcagtggcagcaggcgccgttctcttatcctccctgacgagggtttcgatcgtagaggcgagccacttgtcaaaatctccgtaagcctcagcgatcactcgcttggcttcgtcggtgataagagcagtagcggtgtcttttgctttctgcaatgccgtgagctgggcctctttgtcgaacttgccctgcgcctttaatgtgtcgacataggtctggaaggttgtctgtacggctttcgttacggcgtcgcttgcgagatccacatacttgcggacggttgcgtcgttaatgtttgccgtgatttcctgcgtcttttttctcagccacgcaactgcgaagcctgagagagccagcagcagaggcaaaataaccattgacatgagtgtgttgagagtttcctgatccattccgttgccctccttatgctaattcaagatcggagattttcacccagcttgtgatctctttcaagagagcgcgatctccgtcaattttctgtaccgtgtattttctggacttcacccagctcgggatcgtctggccggttgcgtactttgtggccgagctctttaccttgaccgttttgccctccgcaatagagccagaggcggcagcagtagaggctcccgcaatgtctgaggcatttacccagccataaacggttgatcctgatccgttgaccgcaatcaggtggtaagggtgctttgtaccctccgcggtgtctgttacctttgcctttccagccttgcaggaagggccgctggtagcgttcgcacttgcgtagtgcttggatccggtaaagtttacaatatcgccctttgagtatttcaggccgccactgttgccagatccagaaccggcgctggttgccttgctgctgtacttaggcacgccgtagcctctaatgtagcggccgtttacagcaatttcgcgatagcttaccgagtcactcttgttgccctcgataaccttgatcgtgttacctgatacgctcactacaatgccgacatgctcaggccagccggtatcgtcgccgactccgttgtcgtcccagtcgtaaaaaataacgtcgccggtgctcggtctgtatgcgtcattttctacccatgcgccgagcttctggaaaagctggatcatttggccgcagccgcactcggtcgggataatgtcagtaagtcccgttttaatagccatagctgagacaaaagtcgcgcaccatgagtccgtatattttacggcgtagtttctggcgaggggcttgtggttattgtaaagatcaataattttcttgtggctgccgtcgctttctttgcagcccagataggaaacggctgcattgacgtagctctgtcttaattctttttctgtcattatggtgtacctccttcatagttagagcccggatcatattctccgggctcagtgttctgctttttagattgttctaactccttttgacgcctgatagtgtcgagcttgatctcattctcggccttagccttccaaaaataaaaaccggtagcagcagaaagctcggtaaatattcccggtatgatgtaggcgagcggcgaggtgtcgccggttctccacatgagggcaaaagaaaagaccacgatcacgacggtggcagcagctaccgctcgtaatatggtcttagaaaattcttttctaggtttccgcatttgatcgcctccgatccgtctgtatgttgtgctcgcgttcgaggtgctcgtcaatgcggttgtgcgcgcttttggctgactcatgggctcggccggcggtgttactaattccggcgagctggttgctgatctcgtcgatccggccctccagtcgttgcacgtctctgttgagttggccctcaatacggccgacgctttccttgatgtagcgcaggtccgtttccagagctccggcggcttttccgtctgctttggttactgactggcgcccaaaatagaaagtagcgacagagaggcagagcccggccaccgtgatgaaaatgctcagatctgtcataggatccctccttcctcaaaaatgccggcggccttcaggcgtccgatcatattgccggtcgcttcctccagttgcgcggttttttcgttctgagccacggcctcatattgctcgagtctggagtgcagctcggcattgatctgggccatgttggaaattattgcgttttgcgtttcaataatttcgaggttactcattgtctaccacctgcccttcggtggtctcgagcgtctcaatcgctgcctgcaggtcgttgatctgcttgcgatattcagctcgctgggtgcgtgtcggctcgtactcctcatctgtgagggcgccgtcggcatgtttcagggccttataatctgtcgcagcgagtaactgctgtaagcccctgatttctgcctccatttcttctctggttctcatggttgtggtcctcctttccattgatctataaacagcccattaaataggcggtccatgctttgcacggttctgtatgcgtcccggtgcgacatgctgccacgccatgaggcgtaggaacgtcgaacctcgtcaaaagtcaggacgccagaagctacgagagccgcctgccttttcagctttcggcgttctctggtgatactgtcgcggcacggctttttgatgatccggccggtttctgtgatataaaaatgagttttcaaaaatgtaaagccgtgtttgaggtctacaatttttgttttcttctcgttgataactatgccatattccgagtatattgcccggagcttttcgagacattcctcgaggtatgcaatgctatggtgtagcagataggtgtcgtccatgtatctgccatagcctcggatcctgagcacttccttcgcgtaatggtccgcgcggttcggaagcattacggcattgatctgactcgtttcacttcccagcccgaggcccttatcgccgaaggcagaaataaagctcattcccagcgctatgacgcgtggatccgtgaagatctgccggtatatcttaaaaagcggctcatgcgccacattcccgaagtagtccgagaagtcaatcagaagtatgccgccttcgcgtccgtatttcctgaaatgcctccgcaagtgagttgtcagtctgttggtcgcgaactgggtgccttttccttgctgactcgccccgttgtcgtaaatcagggagcgggtgaaagttgggtatatgatgttagtgcaaaatgatttttgcacaactctctcggaaaaatgcacgcttttgatgtgcctcagcttgccgcgttcgcatatatcaaagcagataaaaccgcggcgtatatctttcccagtaagcagctcggcgcgtgttttggatatattaaaaagcagcaaagagttgtacctctggacgctggctttccagtcgacgccctttgaggcttctcttgctgcttcatacagagagttcagagaggccacgcgctcaaaatcatcatatttcccgattgtttcctgcctctttttcagccttgcagctttccgtctctggtatcgttgttctcgtctttcttcgcttgtcacaatttagctcattcctttgttattacccagcacggctgtcatgcgtttaattagccgcatagtacaacgggtatgaaacgcggaggactcgcacaaactccgcgccatgcaagcagcgtccacccggtagcgtctgggctcttatttacgccttgacggcgagggttatttgctccttccttccactctggcactgatttcgatttttctactctgtctggcatataggtggaatcagaccgggacgtaaagctcgttgctggcgttccagttgttggagttcccgttgttgttgacgttcacgcaattagtagagttgccactcctgacagaagcggtccaccagttgcagcggccgcgtgacacttttcagcaaataacccgagtttattatctggctcttattttgtcgtttttcctccagcctttcagatcgtcgatctcttggttcaataagcccgtgatttcttcgaggcttgcggccgtggccgaaggcacgcacctgataaggcgggagagttttctctgtaattggtagccgttcgcgatcgctttttgggcgtatgccttacggctcgcgagatcctgctcgctcatggcgtagatactgttcgcggcgattatgttgtcgttcagctcgtcaattttcttgataagatcctgaccgatcataaagcgccactttttaggcacatacctctcattcataacatagagcgttacaagatcttggagtttctcggcgttcgcaaggacgtcgaacggcgtctttttacggtttctggtgtatacgttactcattctatgcctccagttacccggctacacgaggtagccggattttgaaattatgccgcggcttacgcctcgtcaattcggaagcagaccgggacgcaaagctcgcggctggcgccccagtggctggagtacccgtggccgtcgacgtgcacgcaacgagtagagtcgccactcccgacagaagcggtccaccaggtgcagcggccgccgccgtttccggcgcccttgatacggttcaaaaagctgttagcaaagatcgggtactgtacgccctgcccctgactccaaccttttgtcccccagatagttgagtcgaagatttcatactcgagaggcacccagagaggaccgagatcctgccagccccagctcgtgctgtcagtgagtgcgccgcttgcgctgtatctgtattccatgagggtgcgcttgttgctgattacggccttgactgctgccggaaggtagccgtaaagggtagtagtgaggaacgtgtgcaggttgcttaccatgtacggtgagttatttgcagcgtttccgttgttgttattggcttcattccatttgaccgtctgattaaagcagtctttactaataaaatcaatgtggtggctgagctgctgatcggtggttctgtaatatgtgtcaataccagcaacctgcattttcaccgtctggccgttcatcgtgataggaatatagtcggctacatgaataccggtaaaattgtgggctttgatccttgccttgatccacgcccatgcgtctgaatacttcgcaatctccagcgcaaagacaacggtcaggtctctgccggcatagaggcgatcgttgtcggacatggctctcgcgagctcctcgtttgtagcttcgagatcctcggccagagcgacggctccggtctttgtctggatcgtaacctccagagcattgtcgacggtcgcaaaatattcctgcgtaatggtcgaaggcgtcaagccgttgtacggcggtaaatagtcggccacgtttgcgatcgcgatcgagtagaggactggagcagcagccgggtgtaattcatcaaccgcataaatgccgatctcattcacataatagccagcggagagatcagcgtttgagacgagtgccgtcaattttacgcaggtatcggtcgccatttcaattttagaaaacgggatctcctgtttctgagctttgagagtagagcgggcctgcaggctggctctggttttctctgagtctgaataggtgccggatccggtcaccagcttggtgaacttgatctttgcggttccggcggttgtggctgccagtaaggcggcgccaccgtttgtcattactgcattgttaaaatctgccataatgcaatcattcctcctttataatgtttttaatgtggtttgtatgtgcaactccggcagccagtggaagctccagaggttgtacgtcgtcaaaatgttcgattgctcccgctttgctttggctctggcctgctgccgtgccgacattcgacacaatgctcgcagagtattccaacgcaaagtagtccataatactgttgcggctgtggtaggatcctcgcccggttcctccgtgctgggtgatttctgccttgcgtgtttcctgaaaatgatctaaaactacgcatttactgaatgaatggtacgcggtgcctccgtggagtggctgctggatcgttctggtaacttcgatcatttcaacatgagagcgcgcattttttaccttgtcgatcatgttcaaaaaataaagcataccgtctttcgtgagcgttgcacttgtctgaattttgaaccagtacggccggccgccgtactcgaaccactccgtaactttacccattccgaaggctgaggtgataagctcctcaaccgcccatttcgtgccgcgcttttcatggactcggtagcatgtgcgtattactgatcttttggtctccagagagaaagaggagtcccaccagtcaatattaaactcccacgccatttcatcgagctgcgcgtcgttcatgttgtcgatctggtcccatttccgcagaattttggctctgttcgccggttcagcgagcagaacgtccatagcgtgagaaagtgccacgtctgtttcgtccgttttcataaatttagggagcagcttcgccatgtcggggttaaaaatgctcattcttgccatgttttacccctccacttcatgcgataccgttaatttgccggaaaatttcgccaccgtcgttgcgctcagctcggtgtataccggtttaataatatcgacgcgatccgcgccagtcagatggttgccgtctgagtcctccgggcaaagtatgagttttctcaaatagtccgggttgatattccggtcgaggctgctgccttgccagtatatgtactggtcgatcgagccgccggagctttctatattttcgacgactgcggtctcattggctgccgttgtgtaatatttcagctcaatatcgtaagattgaatagtcggagcagatacctccactttgtcagtcagtgggcgaacgtcgtcagcgttgcaggctgcaagaactttgtcgagtatggtctgatccggtatttctccaccgtacaaaataggcgtaattaccacaacgcccgggctcggcgagcttacatgtgcgtcggccacggttgcgtcagcagatacggcgtaatatttatatgagtttttaggcccggccgtggatctgctggctggcgcgagtcggatcctttctctcagatcttcgtcgttttcctcgtcgccgcctccggctgtttcctcagtgttggaaactccgtcaataaatgggatcatatcaacaagtacattgatctcgccgacgggtatgtcgttgtatgctgtgccgccttcctcgctttcgacttcggcgtcgacatataaggaaccagcctgcaggactatggtctccgtggttttgaagtagcgagagtagtccgaagttacgcgggttcctttggtgatgatgatgttttgcgttactgcttctttgagagaaaagcgaaccgttgttgtcgctggtagtgcttcgatcctgaacactcccgcaaattctcccagagcgtcgagaacgtcgccccttgcatagcggagagttgactgctttgctgagtcgttcatcgtggagtaaagtgctacaacgagagttgcaagcgtttctccaaaaattcgacgctcgtctccggggtataattcctcggtgacgccattctctaaaacgtacatgataaagtcgtagatctggccggcgtctgtttctatgaattgcaattcgctggtgctactcattgtcctcctcctctcttagtttaatttgtgttatagttgaaaaatcgccgccttgtgcgtctggagcctcgaagtcaatgccttcgacctcgacgcgcggctcgtaagtgtcaagtacccactcagcctccgcaatcgcgtcataacgcgccgaggcgctgggtgcgtctgttattgctgcgtcgatccccttgatacgatcataggggttttcgcctctcgtaagtttcaggagattggccgcgcattgtcgcggatctccgttgttgcttgccagcatgtgatcgcctcctttatgacacgagggacagcgtactgatatatacccagccgtcgacctgcgggaggtatgctttgtttccgttgatttttccaaccttcagaactcgctttttttcactattgagaattttctcaccgtccgcatagtatgagccggtcagcttcacgctgctgcctactgatattgtcacttttttgccctttttcttggctgctttcttctctgctttctttgcttctgaggcggcagctcgggcgccagattttccgctggtttctttcttgtttacctcctcgaacgtgagcccgatcgtagcgaagcggatccggccgtaatcgtccataataacgcccgagaggcttacctcttttagtctggtttctctgccgaagcgacggccgtgcaaatataacactccggtgcttttaatgagagagcaccacgactcgtactctttctgagggtttactccggcgtttgcatgtacgtcaatgtcaaaggtaaagggtacgagctcggtttttttctttttactcttggagtcgtcacccttgatcgttgtcgaagtagagaagtttttcagcgggtttactttctttctggagacttcgaaggttttgtttctccattttgccattactgccatgtgcgatcgcctcctagctcagtgttgcaaatatgaggccggtgtcgtcctcgaagcagacataagccacggcggcgccttttttcagcgttgccgcgtcgatgttgtcagctatctggatattaggagacacgagccgcgtgtccttcatcggggccacctttgcggtgttgccctcaatgctcaggatcacgcctttgtttatggttccgtccattagtagccctccagtttctttctgaaaaatatttttgttttgtgctttccgtaatcgtgtcgcactttgtaaatataaaaggcgccgctccatgacggggcctgctggtttagtatgttcaccattattccgggcgcatatatcggcatgaggctcgcctcaatgctgccgcatacgagcattttatttttttctcgcaatactcctgcagcgaagcggatcgcctcgagggtgctctggcacttaataggcttttgcggtacccatattcgagaattttctcccggtgccttatatgttccggtgtaaggtccgcaagataccgttgccgatccatacgataggacgctgttgtcctcacattctacgcggcaaccggtcgtgtcgattgtgatcgctggctctgttgcctcgagatacggctcataggctgcgatcagtttaccgtcgtatattgtgagagctgcgcgctcgagtgtgcataggcggccgaagaacttgaagtcctcctcattttcttgcttcctatattcgtacacatgatcggccacgccgtagctctcaaactcgagcccgtgccggtttgcgatttcttggccgatctgtgaaaaatgaacgcgctcccacgctttagagttggggatcgtgccgcttggcggcatggaataggcgcgcaagtcgtagtagctggagtcaggagccgaggagtacaagaacattttccccgtgccggttcctgagtccttaaattcaaccggtgatccggtttttaaattccatttgtcgaactgtccgtctgtgtctgatattctgacatgcaaagagtcagagcgccctcccgcatacatttcatgcacgcaggaggagaacgccaccttttcggaaacgtccgtataatttaataacaattcgctcatgctgtcgccctccacggtggtactgtctccgaggtttctgcctcctcaacaacggggagctttaactgcacgccgccctcgaatacgatcacgtcggcatagtccgggttgtattcgatgatgtaatgagccagacgctcgtcgttatacatatctaacgcaagcaggtcgaatgtgtcgccgtcttgtgtggcgtactcgtagtatgatgcaactctacgcaaaagcagtcacctcccttgtttggatccagcgctccagccagtcgaagaactcggcctcgtgagctttgagcctctgcatgaggtcgtcgttgtcctctgtaaccttaccgccagcaataaccgggctccatgtgaagccgctaaaatcgtaaacgatagtggtagaaggctgagatagctcagccagagaaaagtcgtcaacgctcaggagattacccgcgagggctgtctctgatttgtcgtatacgcccagcatttctccggccttttcccagtagcctatattggcagccctgacacttcggtcgaatgagataacggcctcagtgccagcctctccggcgattgttatgccttcagtaaagccaccagtcgcaagcattggtatatttggaatactaaagcccataccaccgacgcccggtacccagtccgggatctttatgccgttaatgccattgataaaagtgttaattccactaatgatcgcattgatcggagccttgaaaatatttgcaattcctgaaacgatacccgagaaaatgctgacaattccctgccatgctccactccagtttccggcgaatacattagtaataaagtcgataaggccctgaaaaatctgagttatagactgcacaatcggggctattccctgaatagcggtaccgagtacgcttgtaaaaattccggctataaattgaagggccggggccagaagttccaaaacctgagaaataagcgatcccagcactgagatcaggggggtgatcgctgtcgcaatcaggctcacgattggcccgattaaattcataacggtgtcgagtatcggcatgagtaagttaatcagcgtcataaggatagggagcaccgtgttgagtagttcgatcacaaccggcaaaactgccgatataatctgcatgatcggcggcaaaattgcggttatgagctgcaccagtaccggcaaaactgccgcaatgatctgagataggagcggcaggacgctgctcactaactgaataaccaatgggagcacttgctggatcatttgaagcagcggcgggatcaactgctggccgatcgtctgggctgtctccaaaagtaccggtacaaaatcttgaaaaagagggattagctgcggcattatgtcttgaattaccgggataattgtctcagtcaaaccctgaataattgggatcagtccctccatagcttcaccgactaccggcattagctgattgagggtgtcaaacatggtatttgcaagcggctcgagagccacctgagcctgctgcttgaacatttgcaggcgctctgcaaagtcgtaagtatcttcggcggcgcctccgatagtctcggtgcttttttcaagctcggcagtcagatcggagaccgagagagtcccgtctctgatagcagcggccatggttgagccggcttttgttccgaaaatttcagaggcgatagtggtcgcctctgtcatgctgcctgcgttcttaatcttttcggcatactgttcgaggccctcgcttgcagatattccttccttcgcaagagctccgacgccttttttcatagccgcgagcacttcgctggtatttacaccggccttgtcaagttgtccgatcagggcggtggcttcgttgaatgagtagcccatttcttggagctgaggggcgaactgctgcacgctgctcattaagtcagtgaagccgaggccggttgactgtgacgccttgaacacatagtccatagcgtcgcccatgtcggccgcgtcaatgttccacgcttggaaggcttggcttgactcctctataacgccgccgaggtcgtcccccagcatgtccgacacttggatcgcctgctttgaaatattttgcaattctgggccagtcaaaccgaggcgcgtgttgtagtcagcgatcgcctgactggcgtcctccattgtcgttggtacgcttttgtaaacctcgttaaaatcatcggtgagagcgtcgagagcgtccccggtggctccggttccgatcctgatcgtgtcgactacatcgtcgaattgcccgccgagatctacgaggtacttgccggcctcaatagtagcctttccgatagcggcacccgcagcagcaacgccagcacctacggcgacggctttcaggtttatgccctcgagtgatttgctggcctcctctgcggctttcccgagtgttgggcttaacgagcccgcaatctccacgatcgcttgtagtgttttgctactcgccacggtatcacctccttcggcctttcttgtgctttaacacttgcggtggtttgcttttctgtcgacgtttttgctcggcggcgagatcctcggccgcctctgcgtactcgactataaaatcaattactcttttcctttcgagctctgacgtgctggtgtggaaggttctggagtagtctctgattgctcgtctgagctgtctgcccctgagtctcccgatccgataaaaaaacctcggccgattttagagaatttagtgagggacttgcccttgatcctctccatgtcctcgaatgtgtaagaagggtttactgcaatgacagcagcgaagccgatgtataaatgcagggagtagtcaagctcgacagctcccgcaagatttccaccctttgagccgctggctttcattttgtgagcctcagcctgcgcatagagttcgccgctgatctcgtcggtgtcgtaactcatttcagtaacctgcacgccgttgataagcaccggcttgttgagtgtgattgttcctctttcttctgtctgggttctcatggttttggttcctccttttatagaaaaagccgccggcgttctgccagcggccatgttttacagtaatttgttgatgtcgctcatgtagtccttgccgtcaattctgaggatctggctcagtctgtcgacgagcaggtactcataacctccgacaaagatctgcacgcggttcgcggtgtaggtgagctcgttttccgaagcggatccgatttctgcaccgatacccgggagcgcagtcggtgggaatgttctgacaaaagccttgcagccttccggtgaggtggagccgtctgctttgactacgttctgcacccatctaaattcaaagctgtgcttgtcgagctttgacattttcccgagccctttatcctcgccgatctttgtgatcgagagctccatattttcgagcagtccgacaataggtaccgtcattgttcccattgcgttgaggtctgccgtcatttgtgaaattgccgggagcgtgaagctagtgtccttagctgtaagcacaccgctgtcgtatacggtgtcagcaaccaccgcgccttttaagtctaaccacatacttactcacctcctccaaaataagcagtaaagccttcgtctgtgtacgatacgcgcgccgttccgctcttaaatggcggggtaggggttgcgctaatatcccagacaaagtcgccgttcatcaggttgctggtagggttggccgtctccaaaaattcaacggtaggatctccgataagagcgccgcggccctttaatgagtcgagctcctcctgctcgtcaatgagtatgctctgctggaggctcagatccatagtgccgtcgatctgggtgccgtggcggcgctggaagccgtttgtaatatacataagcatacggatattaacgtcgaaaatgtagcgggcaacgccgtcggaaccgtactcgtagtaggctgtgtgaggtccccagagcacccagaggccgccccaaaatactgcggtagtaattcccttcgaattgagttcgttgccgtcctgctggtcgaagccctcgttttcagagctggccccaaaatactgagcggtacacatgatctctttgttcgacgggctctccattggaatactgtcatgactgttgtcgactctctgcattgtgacggttgcctgagtgctcaggtggtacgctttgccagcgtactgaacctgcggccagtaaaccttcgaaaaaccgttgttgtagccgttgctgtcggcccactcctcggcttttttgagcgtgtcaatggcagcctttgccttgctgtcgtaaattggtaaatcagcatttacaaaagcgtcccagtggccgtttaatttctgaacgatcgagatcatagccttgtaaacgtctggatcttcgctccagaacggtgcggccagaatgttgagcacggcattgaacatggtgtagagcttggagagagcctgcagcccggtcctcttgccggaggctgtaacgcttccgataatgtcgctcttggttacaagagacggatccacctctgtgaatgaagcctccaccgtgccggtgataggatcggcgtcattcaatgactcaatgactacggcacctttggtatagttgtagtcgagagagtagtctgcacccagcaccttgtcggagagtgcaaaagtgtcaaggataattgtgtcggtcacatactcggcgcggccgttcttgaatgtgagctcgacggttgtcttgacgtctttctggtgtacggccggatctaatacgttgatgatatagatcggccccacatttccgattgtgttcgcaaaatggcagtcgaatggctcgcataaagtgaatttgtcccagttgctcgagtagccgactgttgcctgtgtttttggcatgttctccagcttgatcggtgtgttaatcaggcccttttccttataacctaaaacaaggttaataggtgcggttccgatgtatgccacaacggtatcaacctgaacggcgctttttactttatcgtttccgatctcgccgtaagctccgtgttgatagctcatctgtaaatcactcctttacaatattttttcatagtctgcgggtatcttgcgggccagcccgtgctcgagagtgaactgcacccagcaaaaccagtacgggtaatagctcacgagagccccgtcctcagtaaatgggccgtactctatgttgttttccttgacgagcctcagccccgcaatatactcagtgttctcgattgcttgcagcaccttgtcggtaaagctccagacgtcccgccagccctcgaggtttcttttgaaattttcgctcggctctctgcggtacttcacgccgccgagtgcctgcggatcctgctcgggtaccgccatttcgctgccatgctgccccgggttccatgtcgcaagcgcgagctgtatcgtcatttgaccgatgtgctgcgctggtgcgtgcttgccctttaagagctgcacgcatagcgaaggaatgggcgccgcaatgtctggcggctttctgtcctgagtaggaatgtacatagcaaaggcggccgggtgtgctgtctgcacattgtagccgccgtcgtttactttgtcgtctggaactttcagaagtatgccggggcagacttcctcctcgaaccatttgacaatattgtcaagatcgcttgttatagccatagcgcacctcctagaccatgcgggtgtggtgcagggctatctgggtgatccccagattttcagcccatgagtcaacagtacactctcggccgtccacattcagcgcggagcccggagctttttcaccctccagatcttcggttctggcaaaaataagagtgtcggactcagcaacgcccaaaatgttgccgtttttcatcgtgacaagcgtgtcgttgtcgatgatgatcgtcatgcttttgccctcgattttatgaacttctccgaagtcctcgagctgcatgaatacaagatcaatgtccgacgctatgaggtctttgagactcttactcaaccggatccatagcaccaaaagccggaggggcttcggtgtcgtcctcctctgcaaagtaatcgtcgagcagcttaatgacttcggcctttgtgcgcatattctgggcgtcgagtccgtaagctccagcgagtgcctgcaactccgtgagcctcattttgtcgctgtactctggcttttctggtttttcgttctgaggatcttcgtctccgtcagcttccggctccagatcctgctctggttcctctgcttccggttctgccggatcctctgccggctgctgctcggcgccggcggtttccggttctggctccggctcggcctctgggataattacgtttgcatattcagcaacgccctgagccacgagctcggcctctctctcaggatcgagagagaagggctcggagtctttgtctttgggtaatataatcccgttctctttatagccgtatactccggcgataattttaatcatttggcggctcctttcttcgcatttcttacagtacgctcgcagatacccacggatttttacttctaggaattaagagcgggcggcttgtgactttgatctctctggactcggcctttacgtctgccgtgtacttaggaatacggcggccggtgtaggtgtggaactcgccgtcgtcctgctcaatctgggtaactgctccatagaggccgcggcctgctgccggggctgtcacaattacggtaccagccgggagatatggaacgatctgaccgctttcgtcctcgtaggtctcgtcgtaagtgataagttttaccatgtggccgtctacattcaggatagcgaagcagcaagctccctccggtaaattcataggctcgatagttccgagcataatgctgcggttgtcgaggtatttctggattgtaggatcctgcagcacgatctttgaaactcctcgggccattacgcactcagtagcagggagcccgttctttgtgagcatgtagatcatttcagaaagatctccgtaaatgtcggcgccggttgcgttccattttactgccggtgtgtacttcgccgggttggctgcttcatcgtagaaacggatctcgtactcctcatagtctccgctgccgtacttatcagcgtagtgtctcagcacatagccgttgttgagcatacactgggccgccatgtactcctcgcgccctgagatcattgtgtcgaactctgtcaggtctctgttgaggatctgggcctgtctctgctgaggcgttacgttctggaagagctgctcgccgaaccctttcttgttgaggtcgtcaatggtgagcggtctctgtggagcgataaacggcggcacatagctgaaggtcttgtaaccctcgcgctcgatagtgataccaccctttcgaggcattacgcagggcgcgatcttcttgctgccgtttctatactcgacgaggacctcctcacccgggaaaatatcctcagacactccattgaccggtgcggtagtagggaagtagcgatctcttaaaaatgttctgtgtgtaggcattgcctgaattgccgccagcatagtgacggttctgtaaattaacggtgtaggcatttcgattgtcctccttttcttacatagcagagtcgaggaaaatgccaccgttgcggagcgctgcctcgtctgcttctgtgatagtgtagtcgtcgtcaacgataagggcctctctgttgaaatggccggatctgtacgctgttgtaaatgcgtcggcgcttgttgcgtctacctcgtcgcagagaacgccgaacggtgtgagcgtctcactttctccggctgctgtgccgagaataacgcatttttttgttttgctgctcattgcaacgactgtgccgcgcgcgagaactccttctccgctcgcgattgtgacgcccgcggcgtcaaccgggaacttgccgtcaataaaaagattgtcagcgtcgcaagctccaattttctgatctgctctcattgtgataccctccttattttgttggtgttgtaggtgccggaactgcgccaccgttagcgatcatagcagcgagctgggctacctgagcgttttcgtcggccgcctgatcctttggtgcaggcgcccctgagttcggtgtcgtgccgactccggctgctccagaggcggtaaagtcgtcggcgctgttctgaatgtgctgagctccgagctgggcctgctttttcatagccttaaaagcaagctcctgagctgagcaggctgtcggtccgtatttagcttccttgataagctcaggatctccgactgttgcctcaatcgtctcgatctcctgcagtctggaacgctcggcggttacggcttcgcttgctgctgcctcgcgggctgcgttctcaatctgtgctacgacgtcagggtactgctgtcttaattcttctggtgtcattttggtgttacctccttttggtttatttgttgaaacgctctgagtcggagctgctggcttcgatgtaggcgttttaacgctgttaataattggcacattgcccgggaaattgcgaaaacctttgagagagtgcagcactccgttgacgataatctcgtctttttctgagctcatgcacatgcttgtctcgcagccctcgcggatcgaagtgcaaaaaccattttcgacagcctcgcggccggtgtaccatgtttccttcgccatgatctgtcggatcttctcagttccgaggccggttgcggcgttgtatgtttctgctgcggccttgttggccgcttcgagtctcttgtttacctcgagcagggccttgtggttgtaattccctacaagcgtgagcagggcctcgtgtaccatgaaaagggcgccctcagcgatttcacgagttttgcagcccatagcaatgatagtggcggcgctggccgcaattccgtcgataactgcaacggtgtcgccgttcagctctttgagccggttgcaaattccgagcgcggtgtataagtcgccgcctacggagttaattcgcacggtgatttttgccttgtccttgacctgagccagatcttcgagaaagccttccggtgtgatatataagccctcgaccggttcgccggtccaccagtctgtcggtctctggctcacaacttcaccgtacatggtgatctcggcttcctcgtcgcttacgtcgacgatgttccagaacttctgggctgcgcctgcgggtggagctgctgggccgttaagaactcgcagcgggattgtttgcttttgcatgttgctgatcctcctttaatgaattttgaagtataagagaggcaatagcctgagtagcctcagcctgagcctctggggtggtgccgttagcttccgcgatcatttcgttttcgcgttttaactggttcatgttggcttcccactggccgccattcaaacggatcgtactctgttcgtgggtgctgtacccgtgctggtttgcaaggatctcggcgccgatttctttcgtaggatcgagctgtccctgagacggtccgatccagtcactcccgagccatgctgcacgaatgagcggatcattgaaaaagccgggcgcctgaatacgtccgagagctacggcctcagagagccagatctcataaatgggcttgcaaaaatcattagcaaaccactcccggcgcattttgaacgctttccatgcttccagcagtgcggctctacttgctgagtatgaggcgttgaacgatttcaggagcagatcggcggggatctccagcgcggcgccgcattgttcgcagagtgctctaataaaagcagaaaaaccgcttgccggtcttgttggtgctgcgaacttgatatcttctcccggtttcattacgttaatcgttccggggcccatttcgtaatcgtcaggatccgaaggctctacctctgagccgtttacttcattgaacggcatttcatcggcgccggtgtcggttgtaacaaaagccgtgaaaaagctctcgacgagggcagccatgagctcaccctccgtgtagcgcctcatttgcaggagcggctcaataatctgcgccagatatgtgacgcctctgtactgctcaggcctttcagactccataacatgcaggacattagggagcccggttttttctccgtatgcctcaactctggtccattcggtttcggctgctgcaataatgtgcgggtaggtattgcgaaaataatacgcttgtatcattccgctgtcgttaatctccacaccgtcaaagatccggtttccgttttttgccttgccttcggtagaaaagcagtagtaccccgagttaatcagcggtgtgctgcaacggtcagcctctacgagctggatcctgagagaatacgggcacataggagtcggatcgactcgcttaacgagtccgaacacatcaccactcattagccagctcataagcgcgagctgctgcatggcgtaatagtcatttactccggtagcgtcgcaggcgtttttcttttcggcccagatcttgaactcggcctctgttttttcttgccactcttttgcagcttcctgagacattcccagacgcttggcgtctatgcggctatttaattttagaccgcaacctatgacgtttgtacggttggtcttaatggcagaagtagcaaccggcgcagccatatacagcatacgagcgcgttgccttagtgtgtcattgttgtggtctatatcccattgaggggaggagctgcttgctttgaaacttttcagcgcctttttcttccagcttgcgccggcctctgaatatccatagtttgaagctcgcggggctgctgatcccggacgggcttcgagtgttgccgcctgagcaggtggcccttgtgttttgcttggagttatttgctgcatggttttcgcctccttaccagtcgcgagggacgactccgacggccctgcgctgtgatttgttttcgagcgacgcgatctcgtcctccatttccttgattgctttgcggatagctgagagatctgtctggtatctggtggcgtttcgtgttcctataccataggactgaacgccgccgctgagcatttcctcctcgcgcttatagtaaagctcgaggcgagtctttaatttgctgattttttcagccttttgttgctgtctcatggttcacctccttaccagtcgtcgtacagcttcgagccgctggagcgttttttcttttcttttttctcgacggttttcagcggttggcctttgaggcgcctttctactgccgtgagatctggatccagtattctgaaggctgccattgcatagttgcggcagtcgagagcctcgttgcggttatgtcccggcagcttctcccattgccatttgtcgccgcgtctggttcggacgagcgacagcttttcagatagcaagccagaaaagaaaagagagtcataaccgcgatcctctccgagtggaaagtggcagtatttggctcccttttcttgcaccttaatggcgttcattattttactttttccggcgtctactcccagagtgtagagccagcacttgccgatcagcttaccgtctatgacgatcttcacctttgaaggtggggcggtgtacggtatgccgtcgccgccttttccttttatggcaaaaacgcgcttgttttgtctggccttgcactcggcgtatacctcctgcgtaaagtggccgccggagtccacgcatgtgaatgataccttcaggcccttgccattcttgaagcggtaaacatggtcgatcacatcgtcgagtcgagcccatacctctgaggtatcaggccggccgttgataattcccttttttatgccccacgtttcgccgtagagtccatgcccgaccacttcatactcgaggcggttgtcctgagtgtcaactccaacggtcagcaccagaacgtcgtcagggagctcggcgtcgtattgttcgcgccggctgagcattgcgtcctcgtcctctaaatctccgcgatcctcccataactcaccgagtagggtgttgaatacaaccttcaatttttcaggatcgccctgagcttcgaggaacttcgtgacgattttctcccacggagtccacggagacgaaaaagcgttaagccagaaagagcggtgcccttttaggtatgcgtccgggttctcggcgatccatttcgccggctgctttttcatggttgcttctgtctgaatacagccgcagctcgggcacacccacgttatcgacttgaccttgtaggtctttttatttcgtacctttttgacttcatgctcaaaatggatattgtcgaaaacaatattgtgatactccccgcagtccgggcacttatgacaccagcgctcctgagtaccggcaaaaaaaccgttttcaatgttgctggcgcccttaattgtcggagtcgatacctcgatcgacttcgcattgtagaatgtcgtctgtcttgcctctgccagagcccacggatcgccctcagttcctgcgctggacgcccagcggtcgcgctcgtctccgataatgtagcgggccggagtagaagcgagggcactcgggctgttggatccggtgatcgtcaacatgccgcccgggaaagatttctgcaaaattgtattgccggagtctctcgttttaacgtccgagacttttttcctcagcggtttcgagtctcttatcattggagcgatacgcaagcgcgagaacttccgggcgtcgtcgagagtaggctgcacataaatcgtagatcccggatcctgatctattatgtagccgattatattgagctctacctcggattttccaacctgagaagcagctacaacggttagcttgttgactttgggatccgtgaaggcgtccattatgtcgacaaggtacggtgttcgctcattcctccacgggcctgcctctgctgagctttcaggagataagcggcggtttttctcagcccactgggacactgtgaggcgctcgggtggtttgaaattcttaacagctcgaacgaacgtattgtttaagctgtcaatttcattctgcctgctcatcgtcctcgatcatagcccagccctgccgatcctttacccgctttttatactcctctggatcgtagtggtactgagagagtgacagaaggatctcgtttacctcctcttgtattctggcagaagtttcggccggacttgcaagctccgcggtatcaaccgcaagccgtcccggcatagccattaacatgctgcggatattaaaaacgaggtccgtcgtgatagcttcgacgtcctcagctctgtgcatggttccttcgagttcggcgagctggagctctgcgactctggcctttgcgctttttatatctacctcagcctgcagcttgtcggtctccagcttatcgttttgagctgacgctttgcgatcgagctgcgtgcgcaggtatttgatgtagtccttcgttgcctcgccgacattgtaccggcggcctgccggtgtgtcgtgagttttcagaactccgtcttgtgtgagctgctggatcctccgggcagtcagctcgaacagttcggccattttggttgtcggccagtagcccggagtctcggccggtttttcttttcgtggtgttgccatgccttgcctccttcccggcgtaacgaaacggcctaaaatttttctatgagtctagcaagtttttgggctcgcaagcaccgcagggaaaaattaagcttgaaaggacccgtgaaaatttttttattttcttttgccgggtgcccggcgttcgtgttcttttttttgcttgcgtttctctgcggtgttggtgcgccgactcggcgcgcgagtggtgacttgcctcggcttgcccgggcctgctgccggggctgcgcctctggtgtggcgtggcctttgggtgtggtccatgtccgggccagcttgccgcgcctgatgtggcggctcagtcttagagtgctgagcatatagaaagaggccagccgctcgcatggtgtggagtggtggcctctggttctctggtggtgtatggtgcccgtgtggctgcgtgtgtgccccgtagagctcacccctgagctttggcgagcatttgcttgacgtggttctccagtcgcttgctgaggccctcgtcaatgttctgctgtatgagtggctgcaccttttcgttttcaatcatctgcggcacactcaatgtctttatgctcttgatagggtagcggctttcgctttccctctggaatggtatttgtgtagagccctcgcctcctgagctggcaaggaatacgccggccggcaggttcttccgctggcccttgaatacttcctgacttactcggtatggcttcggcttccgctgggtgggcttcattttgaaatgcgtcggagtcagaactcggcccttgtatgttaatacaacggactcgacgaggttgccctcgactttgagctggccgccgccttttcctttgccgtcaagcgccgcctttacgtcagccttcttgatagcgtaaacctcgcacacggcagcagatacccacgcctgcgctcggctctttgcgtctgaggtgcatttctttattaccttttcagcgtctacccctgcaatattgtccagcgttttgacgagctcctcataatttgacagcatacaagtggttgttcctctggtggctgccatgtgtgatcgcctcctctcagcctaaaaacggcagcaaaaaaccgcccgattttctcgcgcggtttctttacccatttattgcattgtaaaaattataacacggctcaatttcaaagtaaattgcatcttttttgcaccggtaaattgcacgctcagcctgctgctggcggcggctaatcaatggcggccgtgccatacaagcggacagagaggctcttaataaggcgctggcggttcctccagattgttgttgcgtcgcagcccagtgactcagcaatggcctcattgtcaagcccctcgaagtagcggccgcttactgactcataatacggatctggcttgatgatttcgagagcctcctcgagaacatcgacttcgtgctggtccgactcaatgcaggcctgcttgtctttgataatggcctcgagagcctcctctggatccatgcgggtgctactctttgaaaatctggtgatcgacttgcttctcgccggtgttccgtaggttctcagctcctcgatcttttcctcgtcgtccttaatcttgaccttcagcaccgggagggcatagagacgagcctcggtgtttttgaacgccgcctttgcgttctgcggctgctgcaacggcttgtatgcgtccgagactgctgccgcggttttcttcgctacctcgtctatgtagcttttgatctctggcggtatgcttggttttttctgttttgccatttattcatattctccttccttgtattctgagcttatgcctacatcgtcgaaaatctcggcgtatactgccggatctgccggggctccgtctcttatgagctggatctggcccttgttgccggtgatcctgaaataccgctttacaattacgtcggtatagccgggcgttaattccatgaggtaggcggtgtggccggtcttttccgctgccgcgagagtggtcccactgcctccgaacggatcgtagaccgtttttacaaaatccatgttgtcgagtatcatttccataagctcgacgggcttctgtgtcgggtgtagctcattgcctgacctgctgcacctcaaaacattgccgtagcctttgtggccgtcaaatttcgccttgcctctgctgccgaacagacagagctcgtgctggcttctccagccgacgcccatgccgggtgtctctttgtcccatacgatcatcgaacggactccgaagcctgatttttcgattatgtcatacaaatagatccacatgcgccagtcggtgaacacataagcaaatagaggagtgataccctcgaaggctgcggtcaataatttaatataaccgcgggtgctgagtatgtcgtttgcaatcttcggcgcgtctgtctggccttttctcacggttccgatacttccggtagactttccgctctcttggtggccgccgctgcaatacggtggatctgtgagcatgagctccggttctgctccagccagcagctcctcgcggtcctttgcgttggtggagttcccgcacatgagtctatgacggccgaggatccacacgtcccccagcttgctgactggttcctccggtggcgggagtacggtgtcgtcgtttgcctcctctttgtcgtggtctgcttcgcatagagctgtcgcaagttcctgatagaatgactcctcgtagccggtcatttcaaacgggatcgctccggtgtctactgcctcaaaagcctcggccagtttcacgctgtctatttccgcaagctccgcgatccggttgtctgccatgaggtcggccagttcctcctcctcgctggcatagttctgatagtcgactggagcctctttgaattttccatactttgccgccgcgagcctgccgtggccctttacgatcaggcctgatcgggtgctcacggtgatcggctgcctccagccggttgccttaatgatagcagcgagagctctgatctgatcgtccgggtgcttattcgggtttagcggattttctctgagttcctttatcggcacaattttgtcatgcgcgcaaaaaaccggccggccgtctgcgaacgctttcggctcagcgctggtggtgtagtccatgtcgttgatctgtatctcttggcgattggccttcgtctttgtctgagtgatttcgagcgttttctttgatttcgccacttaatcgcctcccttctggttttcttccggttcctgagttccaaaacgagcgatcgcgagctcgttgtatttgctgtaaatagcctcgaaggcttttttccattctggcccgtgttcgttgcctacggttacgatatgggccagctcgtgcgccagcacctccggtactgctcccgcagggatatgtccggccacttctatgagtgggagagtgccgtcgtctgggaaggtagtgcaaccgaccatttccgtgccgtcctcggcggtgattttgtcaaccagtatggcctcgtattctgtgcccgggtaaatttcagcaaaagcctgagcgacgaggctgctcggatcgtttaagaatgggctttttaataattccatgaataacctcctgcaatatgcgggagggcagcagggccctcccttgatgatcccgacatttgtgtcggtgacattatgcaatgatcgtgatcttgtctctgtccggtatgtctttgagtgcttccacgaggtacgccttgacatttgccaccgcctgagatttccagacgccaccgtcagcggccacgagcttgaataccggagcgccgcctctgccttcgcttactctgaaaacaaagtcgctggccggctgctcaacctccaaaaatgtgcggtatggtatcaggtttaccgggttcggtacgagcacgttgtcctttgtggttattccggttttcataactgcctgctgggttgtcccgttatctgagaaggtagcctcctgagtgttcacgatattgctcgccagcatggtgacagcttcgcggtcgtcgctttctttgaagcatgactgcatagaaatgagaaagctctcctgatcgtattctctgccatattcaaaacgaggcagcagggcgttgacctcgaaaagtgtctcgcggtcgcgctcagcaagcaggccagagtataaaagcacctttgtttcgttcacgacctgaataatcatacgatcgcgcaattcttcgcggttctctttgatgtagtccaccagtgaggtgagagtggtcgcagagataggcgctgccttttgcggcgcgtcgtatcttacgagatccttcgtgcagtatgtcttgccgttaatctcgacagttttcggatcctcggctcttactgccagtcctgtgataaatgcgatagcttcctttattccttccattgtttcgtcctccttatgcgtttacggcttttgggcccattgtaatgactttgtgctggttgtttttcggctgttctgcggttgccggctggtcgaccggcgggcgaccgttctcaaatacctcacccgtctcaggatcgaagtctctgcccggtacgagttcgcctgctgccgcctctgccttttcctgctcctgattggccggagcctctgcaggctttttatttctgtttttcaggtccagaggtttgccggttggtgctggctgctgttctgtggcgcctgctgccggctgtgtctcattagcagcgggagtggtagcctgagccggttctgcttccggttcctgagtctgtaaatcattaaaagacatttgcccgcggatctggccgtcgtattctgcgatctcgatctggccggttctcatatttacacccataatcatttgagtgtcgatcgcttcggttgctgcgagcttggtcgtgacagcgatctgggtgcttacgagctgtctcgttttgttcggtgcaaatttgagcgtgatctggatctgtctcttggtggttgcctctgtgttcgggttctgaatgttctcggccacctgcatgagtgcctcgttgagcttttcggcaaaagcaccgccggcgagagtctcgaggttgatgttactctgtacgcttgttttcttcattttctggatcctccttcttggtctttgaattgttcagctcgtcaatgcgaaggctgagctgataggtcgcataagctaccatgtggagctctgcgactttctttttggcgtctttgtgggttactacggttccgattgctgacaaaatcaggaaaacggcccataatacacacacggcggcgccgagcgtgatttctgctgcggtcatttcttcttttcacctcctcccggtgtggttgctgctctgagagcgcactcggtacaaactccggtgactcccgttgcctttacttggcgcgcaagctctggttcccagcactccctgccgcagcgcgggcatgttacaaggtgccagtctgggtgcttgcttgcgtctggtatattggagcggagcggaaggcatataagcccgccgtctccgggtttccacggttttattgttatgttcatctatgtttcccacctttactaaaagcaaaatgttagttgtcccgtttcgtctgcttgcgtattcattggaataacaaagccttcccagtgctcataggcacgcccggtcagacactcagccgctaaaatcagcacgtttatgtcgctggcgtttttcatccatgcgtattctttcacatgccgttttatttgttccagcagcgggagcaggccgtcggcttcggctgctttttcaacgagccgagcccagtccttgatctcatatactccgctggtcgttttgtacgtttccctgccttctgtgatttttctcccgttcttatcctttccgaccactgttgccgtgaacattctcgaagatagtctggtgtagttctcgatcatctaggctcctttctggatagctgaggcactccagttcttcgcgaaggcctccgtgctctgataagggcaaaagagctggccgtctctggtttttacctcgaagcgtccgcggctgcggatatatctcacgatcaactcgtaacgctggccggtgataaatcccattgatccagttgtcccggtgaatgttgcaataatctggagcgatccggttttactctttgggtttttcaaatcattaagcgcgcgtgtcagcattgtgcgttcctccttttgtctttttcaaaaattccagcgtgcccagatgattgaggctgatctcatagtcttggatctcgctgcgtttcaagtgcttgtggccgtatatatccttcatgtctcgccagacgctccacggtatgcggtagaactgctcaaacttaaagctcacgagcacaaagcagctcgcgcccattttctcgtaattctccagcagctcagcctgccgatcgctcacggcagaggcttcgatcttgtcggcgtctgtatgtttggcctcgaaggcaatgcaccggccgccgttgagtattcccttgtagtcgttctgggctttcttggtgaaaaccgcgacatattggccgcgtctgcgatctccgtatggtttcagaggtcgcataggctccggcgttttctcaatgtccgcaatattctgggaccggtagtagttgcacgctgctgagatcatattctcgaagcgttccccggcgtatttagcacggcggccctgctgccggcgttcatactcgatatttctctcggcttcgcatggtgtaggatccgggtagccctctgaatttcgtccgttgctcatatcacgcaccccctctcaacattgagctgccatttctcaggctgctcgcaatcatttcgccgagttctgaggcctccgtcggatctatgttgatatgaaccgcagtaacctctctgagactcttgccggcctccgcgagtagtggagcggcagcaggctgatcggcgtatgcagcagcggcagaggcggcgagttttctcagaggtctgcgctgtgttactgctgcatgattgtagatttccagcacgttctcgataaattccggcgggccgaaaacttggatctcaatgccgagcactccggcgagctggatttcgtcatacattccagcagatacctcgcagccgtaaactctgataagttggcaatatctgaggagctggagcccgcaacgcaggccgagctttctttcctctgggttggagtcgtccacaaactgcgtaaaatacacatgaggggcgagtggcagcaggccgtcattcattgcctcgcggcagtattcctgcgccttgatgatgtttttctcatagtcaccgcgacacggtgagcaaatataagttaatttcattcggtgtcctcctaacatggaccgccgtcgctgcctttgaacgctcccgcaggaaagtcccagagctctgacggggtggtaatttcgtctactgtaaattttccgcttataatctgccggatcgcctcgactgctgcatggcagacacaactctcagcgtctccgacgtattcctctaagtcctttttattgtcgagagtgaagcccagacgctcctcgtcgtttttcaccgcctcaaattcttcggggaatagctcacggatcccggcccagtgcctcggtagtgaaaaaatgcacatcatacacgagcaccggttccagccggcagagtagcaagggtggggcgtcgttcggttcctctttagcacttcccagacgtcccgctctgaataatcaataacagccctccactggtgtacgagtctatgagcctttgcggtggcgtttgaccggtggatctccatttcgttgtacttcgagcgcccggagctttcgcctcggcgttctccagatacgatcaggatctttttatccttgctgattgtttcgaggttcctgatcgtcgcggcggctacgtctattttcaagtaaccactgcaccagcggcgcattaagtcgccagcttttgccgggaacttcatgcggtagccgtatgactttagttcctcgaattcctcctctgtaaaatcgtcggccagttgttcgcggagctcttgacttctgatctgctgttttgactggctgcaggttttgacttctccgtcctgcatgtaccggatcggatagcttgcgccgactctgtaaacttcgccccagaaaccttgatccctccaactaacccggagtgttaccttttcgcgttctgcgaaggcttttacatattcctgagtacaaggccagtccatgcggcgctctttgttctttccgtcaatgtcatggtgccatagctcgatcttgtttttcgggacgcccagctctaaaagtttgaaatatgcagccgtcgagtctttgcctccagaaaacagaacgattacaaggtcgtattcctccagtggcagcagttcgggtaaatagatttttttctcgtagtctgtggcgtgctttccgtcgatgtttggttttattcttttaccggtgccataagaacgatccgagagttttccccatattacgggggtgtctcgactgcactcggtatcttttatgtattccggcatttgatacctcctaaatgatttttattgtctggtgactactgccgggctgccatacgaaccacgagtaactcgtggcgtccgttccgtgtccggtaaagctcgggcgcttatgtagggtgtagagtccggcgagccggtgatcttcctgctgccagaactcaaaacgctggtcgctttccatgaacgcggtgcggagcaggaaaatgagcctgccgcccggtttaagtagcccgagacatttctcaacaaattcgatcgcctgattaaatggcgggttgccgatgataagatcgtactttttcccgagatccatactcaggaagtcgtcaataatcacattgacgccgagatcctgcaggtgttgtgcctcctctggtctgatctccaccgcgtcgatcgaaaaatcgccgtatttttgtagtgtcttgattatgttgccgctacctgctcccggttccagcacctcgatccccccccctcagagggaaaacgtcgagaaatgtctcgatcgtcgagatcggtgtcgggtagaagtcgtgcggctttctggtgcttcctctgtttgttgcactcattgtctacctccttatctgctgcgccagctctggccctccatgacgagcgcctcgcacatttctcgcagccggtccacagtggccctcgctgtcatgtcgtccccattctgaggagtgaggcgtttctccagctcggtgtctgtgtagttgcttgttacaatcgttggcttgtagccttcgtagcgggcgtttatgatcgcgtagatcttcgagacgccccagtctgtcggcggttctttccccatgtcgtcgataatgaggagcgggaccgtttcgtaaactctcaggatctcaccctctgagatttcgcgcttgtcgtatgtagccttgatccttgccagcatgtcgatcattgtcatgcaaataaccggccggcctctctggatcaggtcgttggcgatagcagcagcgaggtgagtctttccgacgcctatgtcgcccagtatgaaaagcccgtttttcttctggcccatattgtcaaaattctgggcgtatcgcatggccgtttctttcgctttggccgttctctcgtccggggtgaggtagttgctgaaggttcgctctaaaaagcggcccctcattcctgagtcacatctgagacgtgacacccggcgtctgatttcgtcctcggctttccgtttttcttcccgctcccgttcgagccgttccttttctctagcctcgactgctcccgggcagttgcaaggaatagcggtggggatccagaagatccggtcgcccatgttgctgagttctttgcctctgtgataccggagctttccgcaatattcacacggcaccggctccggtggtggttccggccagtctctttcctcgttgctgtaaaaccagccgtcactcggctgctgtgaagccggtgagcttgtagcgggatccgcttggtggttcattgccattgtccgggcctcctttgtcgtcatatttgccttccagcactttgcacatgtttgtcggtttcattatccagtcgaagtcagcccgccagttgcgatcgttttcgcccttcataaagctgctcgcctcggtttttctgaataatgtctcgaatatctcaatattcgggtaggtcttaaatcttgcggccaccgccttgcgtctggctccgtcaatcttctggatcttcgagaagctgacgcaaatctcgttgtataactgcatgattttcacatacggagtcggatctgatttagcaggtgccgctgcttcgtgctctggaggagcacttaaaggatcctttatatctctagtcttatctactctagtcttgtctactctgccagcggttgtttgttggtcgtccggcggtcgtccttcggtctttttagcagccgctcggcggcgtctggagcgttccttttcggcttcacgctgctggatcagagtgcctgcgtattcctcccagtcgtggatcgtgagagtagcaggatcctcgtcgccctgatccagcaaacccgcagaaataaaggcttgcagcagttcgtcggcgtctccgtcccactgtgctgcgcgggctatatttcgcgcgcttatctccgagatattgccgtccggggcattatcgagagcccagagccagaacgaagtcaggagcccgatcatgtagggtggagctatttcgagagcgtcggctgcgtctaaaatttttctatgctgtctaattgattgataaattttcaaccatgccacggcgtttcctccttccttttttggtcgtcctttttcttggcgtgtctttctgttttggtcgtttgtcggtcgtccggcggtcgtccgccggttgaccggtagggcgaaaattaattaaaagggagttgatcgtctgcgccctccggtatattcataaaaccgtcgccgcttgcaggaccggttggaggctcctgctggttgccgtttttattcttgctttccgcaaactcggcctcctcgacaacaacctcggtagtgtataccttgcggccctcgcggtcgttgtagcttcccgtctggatccggccagttattgcaatctttgtgccttgtctcaggtacttctcagcaaattcggcgttgttcctgaaggcaacgcactggataaagtcggcagtcgcttcgcctccgtcttttctgcctctgcggtctacggcgagagtgtagcgggctatcgccataggctcattgccttgcgtgtatcgtacttcgggatctctggtgagcctccccattaaaatgactttgttcactgtctgtttcctccattcctcagctctttggccgtgtcgtccatgcgcttgcaaatgtcgtcatactctgcccgagtcatgtcggccggtttcttgctgtataaataattgatcctgccgtctgtctgctctttggagagcccggcgtcctgagctttccggtacattctgtcgagctgggccgctgtgagcttcctctcggctccattctggccgctctgagcggttttattgttcggttggctctgttggttgcctgcggcatttctgaccggctgtgaggccgtttgagcgcttggcttgcctttcatgtctggatcggtttcgcccatgtcaatgctgaatttttcaaaaagataatattttattgcataggtccacgcgctgcctttagctttggccggatcgtcgttccatgcgattgcatgagtctgggcctcgtcggtgtcgtcctcgttgtctgcattggtccagcgcattgtcagatcggactcataaaggaacatgaggccgccgtgctgcgtgttcatggtcttaatctgggcgtttttctcctgaataatgtcgaagttgacgccgagctcattcatcgtgggagtgatagccctccagacgtcgtcaatctttgcaaacttatagggaacctcctcgctgtgctggcccttttcaattcttgggatctggcgccgcagttcgatgaatttctcctgcaggctcattacctcgatcggtttgtcccgccgcgtctggaatgaggcaaccggggagcccgctgcggtttctttctgttcttcttgcatgtggtttctcctccttatgccgccgcacaaaggcggcgggatttatgatttactgaattacgaagcagaccgggacgtaaagctcgccgctggcgtcccagtagttggagtgcccgctgaggccgacgtgcacgcaattagcagagtagccgctcccgacagaagcggtccagtaccaatcaggtgatccaccttttctgttgcacttgatacggttgcggctgtccttgtagtattcgatctggctgtatgcgtcgtcctctgaatagcagcagtccccgaacagctccgactcggtaggtaaaaagaggcgacagagtgagctctcgccgttttcctgcttacgctcaacctcggcgatcgcattgcgaagctcctccggcagactgttgaaaacttcctcgtttaagtagcgcttgacgtctgagtctgcgaagcctccggcgtttctgttgttctgattgtaggcaacctccaccggcaggcagtccttactctcgaagcgagcccagcccgggcccatgtcaacgactacgagatccatttcctcgccgtcgagggttttctctgtaataatgtcgcccaccttcaggccgctggtgttgtccttgattttctgagccagttcctcccagttgattgctgtctcggtggttactgtctgtgttaatactgccatgataagatcctccttattttttctccgcatagaagcggtggttgttaattgtcattatgtagcgctgcgactcgtggaacttactcgccacaagatcgggattgtaaaagtatttgatcggctcggtgcttgctatcattccaaagtcaaacacataccgaacggcctgcattgcctccactgacggctccggtcttttcttggaataggagtagcggtctgctgcctctgccggccggataccgtcgtcctcacatgcctgcaggatacactggcaaattgcaattttacccgccagcggttcgctctcggcctctgctgtgacgatctgggccacctcgtagcgctcggcgtctgtcagttcgtaccggagttcaaaaccggcctcagaggcccacgatctcgcaagctcctccatatttaccgcgtggggttccccgtcctctgtcagatatgcgaagtagtagccgtccggctgtgtttcgtcctgaattatgagagtagtctcctgcggtgcttctgttgtttctgctgccggagcgtttaccggttcttttttcttgctgcaagataccagactcacggtaacggccacaacgagtaccagagcggcgcctgctgccagtctggcaaggaaaacctcgcggcgcctattggcttttctgtgttttcgtgctataatttctctgtgatctttgaaattatggacgggctcaggcgagagcgccgtctccttcttcgcggtcacttgggctggacgttctgggcgtctggccctttttatgtcctcatgtgtttgcattggtctgtatgcctccttttggttcgtagtttctcagctcgcagagggcgagcgtgaagtcttggaaggcgagctgcttcaccagatcggccaccagcaaaacacggtaccagccggagcggtacgtcgccgcgtcctctggctgcatttctgtggctcgctcgagctttctgtctgcataagactcagcccgctgcatttctttgtctgggacctcttggcccagtatctcaaaaaccgccttgcggctgtattcttcggccatgtgttgcgcgcctcctttactttttgtcgttgtcttttccacctttgttgttgtagctgataattaccagcgttacgcaaataatcagggtgataagtacgccgttactcataagattcacctccattcataagatccggcagtctgcacccgagcttgtaagactggggcatgtatgtgatctgtctcaatttccggccggttatgccgtacttcgggttgtagcccagaaggtctatgtagtccgtcaggtcgtcccgttcttcgctcatggccttagtcacctcgtagagcgccagaacgtcgtcgatcgctctgtggctgttctggaccttatcagcgaggccgtagtgctcgattgcgttcgccagcttgtgcgggtatgccgcgcggtccttgtatactgtcagggagtcgagcgcccggagctttggagctttcggaaccatgccgcagcgcttgaacatttccagaatgaaaagcaggtcaaactggatattatgagccaccagcagcacctcgctgtcactgtggagcatattgcagaagatcctgcaggcttcgcggtagtcgatccctttatctgccagcatgtcgtcggtgatatgagtcagctcgacgatcttctccggtatcttttcgccctccggcagcttgcaaaaagcgtcgattttgagctctatgccgttttcggttacgagagcagcggccagctcgatgatctgatccttttcaggatcgaggccggttgtctcggtgtcgaaaaatacgattttcttaaattgctgcaacaatttcctcacgctcgagcacctccttcgcaacgaatagcttttcggtggctgctatcgtcttattttggttcatggtgcgggttacgctgtggatccacaccggcacgaagtcgtcaggagcttcctgctcgctgattagtacaatgttgtcgtgactccagagctgtgcgactctccagaagtccgcgtggtcgaaaatttcaaccgatttatactgctttgtgttctcgtagggtggatccatgtaaatgacgcacccggtcgggttccatgcccggtagtccttatgtaagaaaatgacgtccttcagcttgtcccgctgcgcttcgatgttgcgccggccctcgtcctgatagtcccggagtcctccggttgtctgagtcttgccagagtagccgccgtcgaaaaatctgccattatacgaagccacaaaaccgacatagcctgcgtaccattccgggtagtcgtcgcggctggctctgactttggcgtattcctcgcgctcaatgtagcccgggagctcgccgcctgcctgaatgtactgcatgagggcgatcaggtacttgttgcaatcgctggcgatccgctgcggggcttcgatcttgtcgatcacattgcagccgccgcagaatggctcgagataggtctcatagccggagcgctcgatctgtttctgaatgatcggcacgatgtagcgggcgactttcgccttgcttcccatgtatttcatagggctgctgcctcctttctttgttgtctctgtttcttccagttttgatagtctgccataacggcaggatcctcgaacgctctcgacattccgctgattatggtcctgcagagcgcgtcgctctcattttccgggagtgtatcgagttcgatgttgatattttgcggggttctggatcccacgcttttgagtgttttcattgccataaagtcgctccttcctctgcttggtttcacacaccgggcagacgtaaccgctcggagggataacggccagagcgctgagttgccagtccttaccgcatattcggcaggctgcttgtctcgcttgtgagttctttcttgccattatgggacctcctcgtcgtcgccggcctcggtgtcgtcctgctcctctggggtatcacacccgagagagtggagcagcttgcgggctctgtctcttgccatgcgtttgatcttggttctgtacttcttgcggatccggcgctttttgtggtgttctgccatgtaccaccagtggcggtcattgcaccagatacggtccaccgcgtcgcgtacaaccttcacaattttaccggccagctctttgatccagtcgagcaccggggagagcgtgcgctctatgatttctttgagctcctcgagcttctcactgagctgtcgaatatcgtccgggatctgtatgccgtcgtctggggagcagtctctaaaataatcgggcagcggcggggcggtgaggcctcggcaaaattccgcggtagttattccgctgtggcttgtgtgctgcattacattaaagaggaccgtctcaaagtctgaggggtggctgcttacggtttgcaggatccggttgcggtatttcttgcggatccggtattttctgccatgctcagcgaagtggatccacttgcgcggtatgtaagtagggtagtagtctcttgctttcattgtgcacctccgtttcctaacttacgcggtgcgtaagataaggctaaaaaaaatacggccggccttttctggcgggatctccagagaaaatacgagcttttccatgacgtcggacgagggctgcactttcccgtttaatatgttgctaagtgtgtttctattgatcccggttttctccgcgagctccttaattgttttgatttctttctctgccatgatctttttgatctcgatgtagtcggttttataaatttctgccattgtgtgcctcctttcttaaaaacttacctactgcgtaaggttatagtaacaccagcaagcaagcgtgtcaatactttttgcgtaagttttttaatattatgcacagtattagttgcgttttgcgtaagtttgtgatattctaagggtgttctaaataagaaggaaggaggtgccagacatggccgagatcaacgaccgaataaaggagcggcggctcgcagccggcaaaacgctgttagaagtggctgagtatttaggagtcaaagaagcgacagcgcagcggtacgagagcggagaaataaagaacattaagcatgagacgatcgtctcactggctcagctctttaattgttctccggcgtaccttatgggctgggagtcaaaggcggttgtcaatgatttcccgctatctgatatagagaaggaaataatcatagcataccgcaaaaccgacgcaataggcaaggcttgtgtgcttcgcacgctcggcgttgacgaaaaaggggacaatcaaaaaatggcataaattaccaaaagaaacgcccccgaacttcccgagagggaaatgttataaaattggattttacataaccgacgcggccggcccagaactccggccgatgatcggttacaataaaagtgaaggaggtccttatatatgggaatgagatttagaaagagcaaaaagatcgcgccgggtgttcgcctgaacctgagcgcaaagagcgcaagcatatcaatcggcccgaagggtttcaagaaaacattcagcaccagcggcagagtgacaacaacggtagggatcccgggtaccgggctttcctactcaacaagtaagaaaatgggccagactgctgctggatccacctctcaggaggtgcctgctgcccctgtggtggcttccagtaaaaacaagtgggtaactcttgccctctgtgttttcctcggcttcttcggcgctcaccgcttctatgttggcaaggtcggcaccggagtcctttatattttcaccgtcggtggtctgggcttcggctggatcattgacatggttatgatctgttgcaacaaattcaccgacagcaccggcgcggtggttggtctgaaggttgccgagtataccggacagccggatcttgatcttgcagaggcttctctggaggagcagcgagaggcagcggccgagactgccagagcttacggctataccgtaatagagtcaggcgctcaggataatgccgacaagtaaaaacacggctcgaaaatatgccgcaggaggtagctcggataattcctgcggcgtagagccattacgggcggtcatatacgcaagatattccagcagcggccagcgtgaggagtcgatcgagggacagctccgcgactgctacgagttcgccaaaaagcacggcattattgtcataggcgaatacatcgacaaggcaatgaccgggcgagtggatcgacggccagactttcaaagaatgatgaaggacagcgagaagggccgctttaactgcgtgctgctctggaaaatggaccgcttcgcccggaaccggtacgactcagccatgtataaatataagctcaaaaagaacgggatccgtattttctacgcaaaagagacaataccggacggcccggagggtattatattagagtcagtaatggagggctacgctgagtattacagtgaaaacctcgcccagaacgtgaagcgcggcaactacgacagcgcgctggagctcaaaacgctgggaaagacctgtctcgggttaaaaactggcccagacggtcgctatatgatagatcaggccgaggccgctatcgttcgcaggatcttcgaggagtatgccgagggtgagcgcgcgaaggatatatacgagagactaaactcagagggctaccggacgagccggggcggtaaattcaacaagaacagcctccggcgtattctatcaaataaaaaatatattggtgtctatgagtatgaggacatttatgtcgagaatgggatcccggccataattaccgatcgggatctatttgagagggttcagaaaatgctaaaaataaaccacgacgcaccggccagaggcaaggcgcaaaatttcctgcttacaacaaaattgttttgcgggctttgtggttctccgatgataggcgacggcggcaccagccataccgggaaagcatacgcctattactcatgtacgaagcgcaagcgcggccggagctgtaagaaggagtcggtgcctaaagactggatcgaggaccttgttgtcggagagcttgtcaaaatcgtacacaacgacgaactgatcgagcagattgccgatcgtgtcatggagtaccagaaaagagaaaaggatcagtccggccttcacgcgctggagatccggcaaaaagaaaacgagaaagcaatcagcaacatgctggcagccattgaagccggcataattaccccgagtacaaaaacccggctcatggagctggaggctgatcgtgcggacattgaaaaaggaatagctcacgagctcttagcagagccagagtttgagcgggatcaaattatctattttttagagaggttccgctctggagatataaaggacgaggcgtaccgcattatgctggtcgatacgtttctaaattccgtttatttatatgacgacgatcatctggttttagtgatgaattactcaggagaaaattgcaaggttgatctcaaacttgtagaaggcgctgtcaatggtgacggttgcaaaggttcagcttttgcgccgtcaagcgcacgaaagatgcacagaacaaaagcggcggtatcgtaaatgataccgccgctcagactgtagacaactagcctcctaataggaggcggttgtctttttttctttaactcaggttttcgatgtagtataatagtactatacgaaagtgaggttttttcttatgatggggaaaaaaagattattcagaacgttctcaggtgcagattgcaagcctggatgacctcgtcccttccggtcatctggttcgcaagctggaagaagccattgatttaagctttatttatgacgaggtcaaagatctctacaaaccttatggcagggaaagcattgatccggttgtattaatgaaaatcgttatcctccaatacgtgtttggcatcccttctatgcgcaaaaccatcaaagagattgaagtgaatcttgcttaccgctggtatctgggatacggcctgtatgaggatatccctcatttctctacctttggaaagaactataccagacgatttaaggatacggatctttttcaaaagatattctcccggattctaatggaggtggatgcctgtggtttcctggatacggaaagcctttttatcgatggcacccacatcaaagccagtgcaaaccctcataaataccagaatgaaaccatgaaaaaagaagcccggtgttacgaaaaggagctgctggaggaaatagagaaggacaggctggagcatggaaaaaagccattgaaagaaaaagagtccacgccacagaccataaacaaaaaggtcagcgctaccgatcctgacagtggctggttccataaaggggaacacaagcaggtgttcgcttatgcagccaatacctgttgtgaaaaaaataattatgtcatagattttgaagtgacagcggggaatgtccacgacagtgtatccttctgggaactgtaccggagagtaagcggacgggtaaaatatcccaaatactatgtaatggatgcaggctataagataccggcaatcgcaagaaggctaatcgaggatggaaaggttccggttatgccctataaacgcccaatgacaaagaaagggtattttcgaaaaagcgattatgtatatgatgaatactttgactgttatttatgcccaaataaccagatactaaaatacagcacaacaaaccgtgatggataccgagaatacaaaagcgaaggaaaaaagtgtaaggattgtccgtaccaaaaccaatgtacaggaagcaaagaccatgtaaaggtggtaagccgccatgtatgggaggggtacatggaagaggtggaggagatccgtcatcagacagggatgaaagaaatctatcagaaacggaaagaaaccattgaacgggtctttgcagacggaaaagaaaaacatggaatgagatatacacagtacagaggattggcaaaagtgacaatggagctgacccttttatttgcatgtatgaatctaaagaaactggcaatctggaaatggagaaagggtgggctaaggaaaccctgttcttttgtctggatattcgaaccaatatatttatatataaaattcaaaatggttcctggtgcgatgcacccggaaccattttgtctacagtctgagcggcggtatcgtaaatgataccgccgcttttgttctgtgagccttcaggctgctgactctgtttcccgttatccgaaaaaagaggtgtatcaatggtttacttcgtcagtttatcataacagtctgccttgcaccggtcgaaatccaggcgtgcggttattacggaatagaggtcaccgcacaaagctgagatatcgatggtactggtggagttgactgcttcgatatagtcggatggaatggaagaagcgccgttcagcgctgccgccagctggccgcccattgccgcagtcccgtcgcagtcacgtccgaatgcggcgcagaaggaaaccgtatcgctgtaatttccattgcaggccttaaagatcgcgcaggccgcgggtatcatctccagtggaaataagaagttgtagggcggaaatgtaaccaggtattttgcatacagttcctcgatgaccgcctcgggatccatgacgcgggcggcatagtccagaatctgatccatacgcttcacgtaggagttctgaaggaaatcgacgccctgctcacagaagtggccgggcagactccagtaagcgtccctgacggctccgacaatgctgtcaactgtagcgtccggccgtaaggccacggcgacacccgcggccatgggaccgccatccagtgcggcttcacggggatcaaagggattgatcaaaccgccgacgccatcccagcctgtgcagatctcgtagagcgcagagaaaaaatggcggctggtggatatcctgttcagagcttcaaaatggaacatcgcagtggcccacgtccgttccaaatcgtccgccggtctggtaaccgccagattctgtacgtactcggtcaaaaactgcgcaaattccagagaagtaatccgccgtccgtaatgaacgacagccctggcgcagagcagtaagtagcgcgtgtcatccgaataggagcccggacggatgtcgtgtgagccgaagggatcggcataacggccggcctccagctgcgcggtatccccatgattgatactctgctcgtaatgcggctgtccgcccagtaggcgcggagcaacagggagcatccggcggacctccccatactgtttccggatattcctgtaatgcatctcctcaacagggactcccaacgcatcaccgacggcaaatcccatcaccgctccgtagaccttgtcatataattttgtttctgtcatgattctttcctcctgtttttccatgtttttgtatgcttcttcactttcatgcaaaacacttaaaacaaagagtccgaaaggttgcccttaatataacagtattttgtccgttcgtcaagacggctttttctgccggtactctttgggagacatgctgtaatacgtcttgaacgccttgctgaagtaattggtatccgtatagcccacgcggtcagagatctcctgaatcttcatggacgaggtgaccagcagctcaccggctctctgcatgcggaacgagagtaagtattcataaatcccatatccgtatttttccttaaactgttttgacaagtattccttggtcagatggtatttttctgaaaagaacgtcagggtaatctctctggcgtaattcacctcgatataagtcttaatttcctgcagaatttccgagacagtcagctgtgtggaaccctcggctctaaaactcagctccctgaaaagagaacagaagtaatccgtgaatgaccggattccggtaatcgccgcctcttcttctgcctcgatggaggagggcaggatctcctgatacttttcgatgaaattttcctgtgaaaaattctgcatgattatgagcagctccatcgcattgtgtttcagcgcctcggcggttatgagggactttccgcgctgggtctcaaaatactgatccagaaggctgcggaaatacttttcatcccacttgccgagggcacggcgcagcagttcccggctggaagacagggagacggggattcgggaagcgtacatctcaaaatccgcagatacaataggagcagccgcatataagttcatacgggaggtgatgagcgcggccgttctggaggactccttcagcgcggccacggaggccggtgcgaaactgccgattccggtgagcgtcaccaccccggtgcgccggcagaaggcttccatggcctgtcccatgtggtctgcggcgtacagggaaagcgcgccgggagacaggcttgccgaatgatggccccctgcggtaaagatcccggcgatcaggagccatggctgatccatccggagcatgtattcctcgccggccgccccgtggtctgcaagaagggaggacagaagccgaatgttttcactgtcccaggaaaagtcctccggcaccggctttcctgtgcggatggaggcgatggcacagtgcgatccgccgctgtctctggaacagaagagattgattaaatcccccagcggattggctcttgtaagctccagctcatcgttcagctgtttcacggcattttccaggcagtggttcagttccgtttccgacaccggtttcaacagatagtccatgatctgaaaccggattgccttctttgcatattcgaaatcgttaaaaccgctgatgatgatgtattttgcctttggaaaccggtgcgtggcggcttccaaaaactgcatgccgttcatcaccggcattttgatgtccacaagcacgatgtcgaccggcgtctgctccataaagtcgagcgcgctctgaccgtcggttgcttcaaacggcggattaattccgttttcgttccacatgcctaaaaacgagattgcctgtcttacgtgtttttcgtcgtcaataatcaatgcgttatacatgcgtctgtcgtctcctcgtccgttaaatgaatggttattacagcttccgtccgtatcccggggctgctccttaagcgcagggaagcccggtctccgtaataaatttttaaccgggtgtttagattgcggagtcctatgtgttcaccgtttgataccagcgtgtctccggcagaaaaatccgtgatgatgcgctcgagcgtgtcgggaggaattccaggaccgttatccgtgacggatatgatcagggagccctgatccagctggaccttcagctccatacgaagctgcttcatgctcgtctcaaggccgtggctgaccgagttttcgatcagcgtgaatatggccagcttggggatcatgatccgggagacatcgtcaccggcctcgatatccgtggaaaggcggtcctcaaagcgtgccttcagcagcagaaggtaattgcggacatactgtacttccaggctgacgggaaccagaacggactctttaaatgcatatcgcaggtttgcagccagagcctcgatcattttatagatttcccggtctccggttacgatggtgcgcgacgagatgacctgcagggagttatagagaaaatggggattgacctgtgattccagcgcctgcagcttggcggttttctcccccagagccatgacgtaattcttctggatcagttcgtcaatctgccggatcatggcgttataccgatgggccagcatgcgggtctcgtagcttcctgtttcctccagcgtcgttttcaaatcgccctttccggcctgatccatctggctggagagccgttttagggaacgggtgagtaagtggaccagaaaggcgattgccgtaatggagatgaccgtggctgtaatcagtacgaggaggctgatgtttctgctgctgatattctgggcagtcagcgtatcgacggagatcagcttcgtgagcagccagtggccgtccctggacaaatgggttacgcagagatattcgtcattgcggaacatgactgattcctgttttgcagtatcctccgtggagagggggaacacgggcagatccgtaagctgcggactgttgagaaagtaaggggttccgtcctgatccgacagacggaacaggctgcttttgtcctgccctaaatccttgattatggaattcatgatgctcatgtcgcaggtggcttccacgacggcgaggggctttttcgtataggcgttgataataacccggtagattcggagaaagggggcggaagaggcaaagctttcttccggataacagacatccggacggtaaggggcgatacaggagtagtcagggctggaggcggcagccagaaaccagtcttcctgctcgatattcgtttcatgtgagaccgagacctttttcgtatcacgggaaaaacggatcatggtatcgtttcgcagcatatgtacggaaatatcatacagatcgtggcgggaatagaacatggccttcatatagttgcccagagtttcctgctcgatatagccgatgtcgggggactcgattatggaaagaattccgctgtccatgcggacattcagtgtaaaattcttaagctccgcgatgtaggtctcgaacccgttgttaaactgctccagtataatttcattggaccggaccgcattcgtgcggatgatcttaacggtggagtgatagaaaaacataacagtacataaaagtacgagaacaacggtcgtgcccacaatcatgataatctgaacggatatatgagaaaagagcgtttttaagccgctgcgaagtttttttgcatgaaaaagtttcataaagagtcctctccgaatttttcgtattttcttatattataccaaaaacagggcgatatgctatcggaaattgtcaaaaatgctgttcattttattccatataataattcctgaaaattccattaaaataactgcacaaaacaggtatgatagtatcagcttcagacagaacaggaaaaaaggagttacggggatgggtgaaaataaaatgaaatcgaagcagggcagggaaaattttatctttgtatttccagcgctgattctcgtcgcagtggtgttttacattccattttttatgagcggttactactcattgaccaaatgggatggaatcgctaaaaaaccggagttcatcggattcggcaactttattcagatttttacggcggataagacctttttaaacgccatgctttttaccggaaaatatatgatcttttttgtggttatcgtcaatgtcctgggacttcttctggcggtgatgctggtgaagagattaaagacggccaacctcttaagggcggtgttcttcgtcccatatatcatgagcatgatcattgtgggatttatctggaaatttatctttctgcaggggttcaatacgctgggcgagatgacgggatggggaatcttcggactcagctggctgggagatgagaaactggccttcgtatccatactgatcgtatccatctggcaggcagtcggcttctatatggtcctgtatattgcagggctccaggccattccggaggacgtgctggaagccgcagtggtggacggggccagtggaacggcgaaattcttcagaattacactgcctcttctcggaggcaccgtcaccacctgtattttcatggcgctgaccaacgcgattaagatttttgatatcattctggctctgactgccggcggaccgggcggctctacctacagcgcgaccctcgatgtataccgggaggcattccagaacaacaactttggacttggctcggcgaaggcactgatcctgtttgttaccgtcatgctgctgaccaatgtcgtgttaaaattactgcagagcagagaggttgaactgtgatgaatagaagaaaaagagcggaacagacgccgaagagaagcgttggccttatcattctggaagtgatcctgatcctgtgcgccgcggtgtacatttatccggtattcctgatgtttacaaattcctttaaatcatttaaagaggtgctggtcaacgttgtggcgctgccgacgcatctggagtttgccaactatacccacgtaatagaaaaaatcaattatggacgtctgttctttaacaatgtggcgattacatttacgggaattatgggaatcgtgtttttttcctcactggccgcctatattctggcccggaggaatacgaggtttacgagagctgcctatatgttctgtatcataccgatgctggtgccgttccagactattatgattacgctggtgaaggtcatgaagacgctgcacctttccggaagcctgctggggctcggaattcagtattggggatttggaattcccatggcggtgtttatctatatgggatttatcaagacgattccgcgggcaatcgacgagagtgctaccatagacggcgcctccgcattcagcacctatgtgaggatcatatttcctctgcttaagccggttaccgcaacggtcatggttctcgacgtcatgtggatctggaacgatttcctgcttccgatgctgatggtcaacagttcgccgaagaccaaaactctgacgctggcggcgtatacctttgtcggccagtacaacacgcagtggcaatacgccatgactgccatggtcttagcgctgctgccttccatcttgttcttcattttcatgcaaaaacacattataaaaggagttgtcgccggtgctgtaaaagggtgattattccaaaaaaaatcaaaaggagaagggttatgaacaaaagaaagagaatgatttccatggttatgagcgccgcgatgacggcaggacttctggccggttgtgcaggcaatgcgccggtatcggaaacgggggcttccgcggcggctgccgaagagaaagagatttacatgtttgtgagctgtcccgagaatgcagacgcgattgccaatgcgatcgaagagtacaagaaggtagcccccaatatcacaattaattacgaaacgacacagtcggattatccgaccttattaaaggcgaagatgaactcgggcgacacaccggatatctttgcatcgacaggcggccaggagatgaaggcctatgcggagtattcctatgatttatccggccagcctctggcgtcttccctgacggactcggcaaaggccaccatgacctatgaagacaagctgctcggaattccggtcatatccaacgcgtttggcatgatgtacaatcaggagctttttgaccaggcgggaatctctgccatgcctgccacttttacggagctggaggcggcctgcgagaagctgtcggccgcgggcattcagccatttaccaacggatacaaggagtggtgggtttataagtatgtgttccagaactttatagatgtggccagcgagggagaaccggaggcgcttgtacagagcttcatcgacggaacggcaaaggtatcggactatccggtgctggctgaaaattattttgactacgtggatctcactgtaaaatacggggatgccaagcctctggagacggatttgaatgcggaaattacggcattttcaaccggaaaagcggcgatgatgactggaatcggagcaccgatggagccgagcgtaaaggcgatctcacctgagatgaagatcagcttctgcggctatcaggtcgatgagaatccggagcatttcttcatcgtagccggggcggagcaggcgtaccgcgtcaacaaggactcgaaagtattaaatgagacactggattttttaaactggctctactgtgactacggaaagacatggttcccggaagtgatgaatgcgattccgccgatcggtgatacacctctgccgaatacagatgtcgcggctgcgctgaccagctttatggagacaagagaaccgggagttccgtcggcagtctactctctcgacagcttccaccagaaattcggcgagatcatgcagagctacgtggccggaagcaagacccgcgaggaggccgtgaaagaaatagaacagcagtggacagaactgggggcaatcgaatgaaaaaaatcatgaatgaaccggacactctcatcgcagatgaactgcagggctttgcaaaaatatatccccgtcaggtgaagctggcggacagtgtgaccgcagtcgtcagagcggttccgaagtctgccggaaaagtgaagctggttatgggaaacggcggcggtcatgaaccggcagtcatcggctgggtaggagaaggcatgtttgactgtgatattgtcggggatctgttttcggcgccatccggagagaagatgtttcaggcgatcaaggagatcgacggcaaaagcccggtcttactgtgtatccagaatcacgcgggtgatgtaatcaatggtaatatcgcctggaagaaggcggtaaagcacggaatcgatatccgaaaggtgttgttctatgacgatattgcctccgcgccgagagaagagaatgaggagcggcggggcatcgcgggcatgctgttttatgcgaagattgtaggcgccatggcggaggccggggcctccatagaggaatgcgcagagatgtttgaacgcgtcagggacaacacgcggacgtatgcggcggcgtattccagctgtacgcatccgggcacgggccttaaaatgtttgagtacctggagaataacgatttgatggaaatggggatgggcgttcatggggaaggcggcggagacaaccgcatccccatgccaaaggccggccggctggcggaactgatggcggatgcgctgattcaggataagccgtaccatccgggagagtcactcttaatactggtcaatggcacgggtgccgctaccgccatggagctgaatatcttatacaatgagctggagaagaccttccggtctaaaggctttgagatcgcaggctgccgggtcggcaatttccttacgacccaggaactggccggtgtgtctgtatccatctgttccgtggatgataccatgaaagagctatgggaaagaccgtgtgactgcccgttgtgggtgcaaaaataaggggatgagcgggaggcggatatgaacgttataacggtagaggaactgcgggaaatgatgatctgcgtctgtgacagcgtagccgcagaagaacgccgactgtgtgaactggacagctttgtgggagacggggatcacggtgtcacggcggcgcgtggattccgggctgtgaaaaaggtgctggaatcaaagcagtatcagtcaatggaagagctgctggaggaagcggcggaaacgctcagcgagacgatgggaggagccataggcccgatcttcggcagcatctttgaaggcgcggcggagagcgcggcagggcgaagccggctgacggcagtggaattgggggagatgctggagcaggggcttaaggaagtcaagatgatcggcggcgccaaagaaggggaccgcacgctggtagactgtctggcgcccgcggtgtgcgctttgaaggaggcggccggggctggagccgatttatccgaggcccttatgagggcggccgatgcgggagcagagggcgtggaggcgacaaagaagatggtggcgaagaagggacgtgcgaaattccttcaggagaagtctctggggcatcaggacgcaggagccacctccatgtggattgtattaaaggcgatgagtgattactgcgccggtaaatagagaggaataggaatatgcctgtagttacgctgcgagaaatactgaagaatgccggccgtgggaagtacgcggtgggaatgttcgatgtgcatcactctgatatggccgaggcggttctggaagccgcggaagaacggaaagctcccgtcatcctggcattggcggaagtacatgccgtacagccgggacagctgaccgcggtgggctccatgctcgttcgggccgctgaacgggccggagtcccggttgccgtccacctggatcacgcggtgtcggtggagacggccgtgcgggctatggagctggggttctcctctgtcatgtacgacggttctaccctttcacttgaggaaaatctggaaaacaccgcgaagacggtgcgtctggcgggagcgttcggcgcttccgtcgaggcggagctgggccatgtaggcggagaggaagggaattcagacggcagtggcgggagtgtgtatacaaaaccggaggacgccgcatattttgcggagatgaccggggccgatgcgctggcggtatccataggaacggttcacggaagataccgggaaaaaccaaatttaaatattccgcttctggaggaaatacaccggcgggtctccatcccccttgtgcttcacgggggatcgggactgagcgatcaggattttaaagactgcatagcggggggcatttccaaaataaacatttacacggaaatcgcggaggcggccagaatggttctcatagaagatgccgggagtctgggctattttgacctcatgcagaagtccaaaagggcgatacgggctgtggccgcagaaaaaataaagctgttcggctcacagggaaaagcaccggccctttcggagccaggcaccccgccgcaagaaacgggggaataatcagaggaggcatcaatccatattctccgacatgctcatacccggttcgtacacggcatactggttgcgtccgtgcagcttggcatggtacagagcgatatcggccttctcatagagtgcttcaaaggtagtcccatcctcggggaaggccgctgtgccgatgcttccggatatatgtgcttccggctccagggcgctgccgatcaggctgcagagattctccaggcgggcgtataagtccatggagtaggagacgtctttcaacagtatgatgaattcgtctccgcccaggcggccgaagacatcatcacggcggagcgctgattttaagcgcacggccgcggtgcggagggccttatctccaaactggtggccgtaccggtcattgatctgtttaaaacggtcgatatccagcatgatcagaatgtggtggtcctggctgttcttcagaatatggcggatggcgcggactgaggtgccgcggttcaacaggcccgttaaggaatcctgcttcgacatttcctggagcgtcaaggcttctttcttctcttcgtcgatgtccttaatcaggataaatgccttgatggtgtcggtatacggatcgggaacgatctgaatcagccccaggcaccagtaggcggtgccgtcgggacggagtcttctgtgttccgtctgaagggagcggttgccgtggtagtagtggtagagcagctggttgcggttaaacacctttaagtagttttcgcggtcctcttcatatatgaagtgttccgcgatgtaattgatgatgtccgagaaggtgttccgggcgtattccggaagggtggaggtaagctcgcccaggatttcctcaaacagatcgtatttaagattgtattcgtaatagccgatacagtcttttttttgttcattcatgtactccatccatttttggtaggcaagttctttttcatactgcccggtaatatcctgataggagataatacttcttaacggttcccggttctgtccgtatatgagagagtagcaggcagaaaaccagtggtattccccgcttttcattttcatgcggatgatcgattttccttcggggactccattttccatggaatcgtaaaagtccagaaattcctggacgctctctcggtggataataccgttgtcgatgataaaatcaggggttggcgggaatgaaatgggaccgggaaatgaaaatgctgaatcgggtggctgacagagagttttcgacggaacgtcgtaaatgctgatgttgcatccggagtgccggctggcgaggcggtactgctcctcacggatgagtaattcttcctgacgtttctttctgtcacttatgtcgatgatgataccgtagagaacctcttctccgcctccggggacgtagtttatgcggatgaggtaccagcaggcgtctcctccctctgccggacttcggaattccagttcaaaacgcgcaggtgaattccctaagtgtcccaggatttctttctccagttccggataatcctgtggttccacgatttcttccaggcgttttccggctccgttcagctgtttcagctcatggttcgcatagaggaccggaaagccgctttcggccttcagttttacaatgccgcagggcatattgtcgagtatcatatcggatttcatatacatttctcccttaagtgtgttttcttatgaatggtaaaacggatattgttataagtgtatgaagaggaggcgggaaaaagaaccgatatgaaaaaaaatatagtaaagattggaaaaatggtgtatactagcatgtgcgggtgtttgagtaagagatacaggaggagacatatgcttacattagaaaacctatcttttggcgtacaggatgagaagagccagaaagagattatcaggaatttaaacctgaccatagagagcaataaatttgtcgtcgtcacaggtcccaacggaggcgggaaatcgactctggcgaagctgattgcgggaattgagaagccgaccggaggacggattttactggacggggcagatattacagagaagaacattacggagcgcgctcagagcggaatcagctatgcattccagcagccggtccgttttaaagggattgaagtattcgatcttctgcgccttgcatcgggaaaagagcttaatattacggatgcatgtcagtatttatccgaagtgggcttatgtgccaaggactatatcaagcgcgaggtgaatgacagtttatcgggcggcgaactgaagcggatcgagattgctaccgtgctggcgcgcggaacgaagctgtctattttcgatgagccggaggcgggaatcgatttatggagcttccagaatctgatcgcagtattcgagcgcatgcgccacaacatcaaaaatggttcgattttaatcatctctcatcaggagaggattctggatatcgcggacgagattgtggtgatcgcaaacggtcagatcagcatgcagggcccgaaggatgacatccttcctcatcttctggggacagcttccgcagtggatgcctgtacgaagttttacaacaaggaggaggcatgacatggcaaagatagatgagattcagaagcggttgttagaagaagtcgctgatttacatgacgtgccggaaggcgcatataatctccgcgccaacggccagacagcgggccggaacacgacggccaacatcgatatcacatcgaaggacgacggcaccggcatcgatattcatattaagccgggtacaaagcatgagagtgttcatatcccggtcgtgttaagcgagagcggcttgaccgaggtggtttataatgatttttatatcggagacgacgcagacgtggtgatcgtggcgggctgcggcatcagcaactgcgggcagcaggattcccggcacgacggaatccatcgtttttacctgggaaagaattctaaagtgaaatacgtggagaaacactacggtgagggcgacggcaacggcaagagaatcatgaacccgggcacggaggtgtatctggaggaaaacagctacatggagatggagatggtccagatcaagggcgtggattccacaaaccggaacacgaaggccgagcttttagccggcgcgaagctggttatccaggagagactgatgacacacggcgctcaggaggcggtgagcggatttgtggtgaatttaaacggggatgattccagcgccaacgtcatttcgcgtgcggtggcaagagatgattcgagacagaccttcttagcggagatcaacggcaactcaagatgcgccggccattccgaatgtgacgccatcatcatggaccatgccaacatcagcgcgattccgaagatcacagccaacaacacagatgcagccctgatccacgaggcggccatcggcaaaatagcgggagaccagattatcaagctgatgacgctggggctcagcgaggcggaagcggaagcgcagattgtgaatgggtttttgaagtagggagccggaaacggatgaaaaagccaggataaatcccttcatgtcctgctgtttcagttaaacaaaaattttttaccccctcggattcgagggggtaaaatctggatcatacagtccgtttactcttgaataatcttaggattattacatatcaaataaatctgcatgggttcctgtatcaaccaatgtcaaggtaagaatatcgttttccaataaataaatcaacagccagtcaggttgaatatggcattccctgaaattctttaactctccctttaactcatgatctcgattcttttcttccaaaggtattccctgaagcagtttttcaacgatagaatcaagtaaagcaatattgagtcctcgtttttttgctaatttcaatccttttttgaacttccctgtcaatactaaatgataggtcataaatcaatgtcctctaaagcttctgaaaaactactatacttttttgtattcgggtctttactaatgcgctttgcttctgccatcgcctctaatacttccggtttatattttggcaattctacattaaatgggagtcctccccgtaaaacacactgttttaaaaaaatattcattgcgccggacagatccattccaagttgtccaaataactccactgcctgtttctttagctcttcttcgattctgatttgtgttggtatagttgccatgttatcacactcctttaaagaaattatatgacaaacactttacaatgtcaactgtttgtatgaaccggactcttacgataaagataaaccggccggcccgattccgtcttcctctgcacttcgccctgaatcaaaggaagcgcataatcgatgaacgcctgcgtcacatcggtgccgcggggattcatccattcagagggaaagagtttttccctgttgcagacctcattaacatcgaccgtgccgcattccagatggtatggaccgttttcattccgtataaaggaaatcatgcgtccggtaagccctgagacggcggcctttacgccttcacggccggcgagaacggattcctcgatatcggtggcggaagccatcatgccggaacagcgctgattaacgtttaactcgatggaacggaccttgacgccgaacttgtcccgtatgaagttttccagcatcttaccgctgccggtcagcattttatggccgaaggtgtcgagccgggcggcatccgcatattcacagatgaacttgcccctggcgtcggaaatgccctcggagatacagataacgacagtgctgttcttcgataaggcggcagtcacatcctctgtaaactgttcaaaatcgaaatgcgtctccggaagatagatgagtaccgggttgtccccatcgtatttgcgggcaagggcgctggccgcggttacccagccggcgtggcggcccatcagttccacgatggtaacggatttctgctgatagacggaggagtccagaacgatttcccggaccgtatcggccacgtacttggcggcgcttccgtaaccgggggtatggtcggtcagaacgagatcgttgtctatggttttcggaacaccgatgaaacggatctcgctgtgatgatgggaggcgtagcgggacagcttgctgaccgtgtccatggaatcattgcctccgatgtagaagaagtatccgatgttcatcttccgaaacttctcaaacagggccgggtagaacggtgaggataagttttccggcagtttatagcggcaggaacctaaataggccgccggtgttaattttaaaatctctaattcatctgaagttaaatccgcggttaaatccatgcaggtaccggacatatagccttcgattccgttaatcataccgtagacgtgatcaatggcttcctggtttatgccttcccttatgacgccgtagaggctcgcgttgatgacggcggtagggccgccggactggccaacgattgcatttttcttcatgtgtatattctccttttttgacgctcctcctattctataatagaaacgatggctttgcaacccccgctttttgtgatcgcgcaaggttagacaaattttcacactctcagccatacctattttttttgaaaaatctataattgagatagaacgtatgagactaaaatacagtctctaagtgctcatagcgaggaggataacgggatgcagtacggacattttgataatgaaaaaagggaatatgtgatcgaccgggtggacctgcccacgtcgtggaccaattacctgggagtgaaggatatgtgcgccgtcgtgaaccatacggcaggcggatatctcttctataaatctccggaataccatagaatcacacggtttcgggggaatgccgttccgatggaccggccgggccattacgtctatgtgagagacgatgagacgggggaattctggagtatttcgtggcagccggtgggaaaaccactggatcaggcgaaatacacatgccgccacggcctgtcctacacgacgtacagctgtgattaccagggaattgaggcggagcagacactgtttattccggcagatgatccggtggagctctgggatgtaaagctcaaaaatcagagtggaagaaaacggaaattaagcgtttactcttactgtgagctttccttccaccacatcgaaatggataataagaactttcagatgagtctgtatgccgcaggatctacgtatgaagacggcattatcgaacacgatctgttctacgaggagtttggataccagtatttcacctcagattttgatccggatggtttcgactgtctgcgggacaaattcatcggcctctaccgcaccgaggataatccggcggcggtggaacgcggcgagatgagcggaagcttcgaaaagggcggcaatcactgcggtgccctgaaaaaatgcctggaactggaacccggagaggaatcgagactcatcttcctgctgggcgaggggaagcgggaggatggccgcgccatgcgggcaaagtatgcggatcacagcgccgtcgatcaggcatacagcgatttgaaagcgttctgggacaataaattaaaccggcttcagatcgataccccggacgagggcatgaacacgctgatcaatacgtggacgctgtaccaggcggagatcaacgtcatgttctcccggttcgcctcctttatcgaggtcggcggccggaccggactgggataccgggatacggcgcaggatgccatgacggtgcctcactccaatccggagaaatgccgccagaggctggtagagctgcttcgcggcctcgtgtcggccggatacggcctgcacttattccagccggagtggttcgatccggacacggaggtgaagccgttcaaatcgcctacggtcgtgccgaccccgaaggtttctgatatgatccacggccttgaggatacctgctctgacgatgcgctgtggctgatcgcctccattgtggaatatgtaaaggagaccggagagtacggattctttgatgaggtcatcacctatgccgacggcggaagcggcacggtctatgagcatatgaagaaaatcctggatttttccgcggagcagatcggggctcacggcgtctgcaaggggcttcgtgccgactggaacgactgcctgaatctgggaggcggagagagcgcactcgtatccttccttcattactgggccatcgacaacttcctggaggcggcttcctggctggggagagaggacgatgtgaagcactataccgatatgcgccataccgtgaaggagatctgtgacagggagctgtgggatgacggctggtatatccgcggcatcaccaaaaacggaaggaagatcggcacccatcaggaccgggagggcaggctgcatctggagtccaacagctgggcggttctgtccggcgctgcggattacgaaaagggaatccaggcgatggacgctgtggatgaatacttatacacaccgtacggaattatgctcaatggcccgtcctacacggttcctgacgatgatattggctttgtcaccagagtttatcccggtgtaaaggaaaacggatccgtcttcagccacccgaacccatgggcgtgggccgcggaatgtaaactgggaagaggcgaccgggcaatgaagttctatcatgcattgtgtccttactatcagaatgatataatagaaatcagggaggcggagccgtattcctactgtcagtttattatgggaaaggatcacacggcttacggccgggcacgccacccgtttatgactggaagcggcggctgggcgtatttttccgccacccgctatatgctggggatccgtccgcagtttgactgccttcagattgatccctgtattccggccgactggaaggaattctctgtaaaacgcgtatggcgcggcgcagagtaccgtatctccgtgaagaatccggagggcgtgatgaagggcgtaaaggaattgatactggatggcaaaaaggtaagtaagatacctgttttcgaagcaggaagcagtcatgaagtaactgttatcatgggaaatgaaggaggagaatcatgattaaatttggcacaggcggctggagagccgtcatcggcgatgattttacgagggagaatatccagaagctgtccaaggctctcgtaaacaagatgaaggacgagggagtcgcggaacagggcgtggctatcggctacgacaggagattcttatcgaaggaatccgcgatctgggccagtgaagtgttcgcggcagagggcgttccggtgaagtttatcctcggttccgcaccgaccccgctcatcatgttctttgtcatgcgccatgaactgccttacggcatgatgattacggccagccataatccggcggtctacaacggaatcaaggtattcacaaagggcggccgtgatgcggatgaactccagacccaggagattgaacggtatattcacggaatcgaagaggaggttctggaagcggcctgtgtcagccgcggctctgaagccggggaaccggcggttcgcatcatggagtatgagaaagggatcgggaccggaatcatcgaggagatcaatcctttaaatgagtatctggataatattatcggcgcggtcaatatgcaggccatccgggaccgcggtttaagaattgccatcgatcccatgtacggtgtcagcaacacgtcgctgcggaccattttggcgacggcacgctgtgacgtacaggtgattcacgaagagcatgacacgctgttcggcggaaaattgccggcgccgtccgcatttacgctgagaagcctgcagaattacgtggtagaccgcaagtgcgatatcggaatcgccaccgacggagatgccgaccgcgtgggcgttatcgacgatacgggcaaattcctccatcccaacgacattctggtcatgctttattactatctggttaagtacaaaggctggaagggcgcggtagtccgcaacgtggcgaccacccatatgctcgacaaggtggcggagggcttcggagagaagtgctacgaggtgccggtaggctttaagtatatctctgcgaagatgaatgagacgaatgccatcatcggcggcgagtcctcgggcggattgacggttcggggccacatcaacggcaaggacggtatctacgcatccacacttctggtggagatgatcgccgttaccggtaagaagctgtcccagatcgctaaggatatcgaagaagagtacggcgcgatccatatggaggagcgcgattacaagttcagccaggagaagaaggatcagatttatgacaccctcttaatccagaaacagcttccggaaatggatctggagatcgataagatttcctatctggatggctgcaaggtgtactttaagaacggcggctggattatcgcaagattttccggaacggaaccgcttttgaggatattctgtgagatgggagatccgaaggacgcggtgagaatgtgcgagagttttgaagagtttcttgatattaagggaaacaggaattaatggattgactggtaaagaaagtaaacagattggtaaacggatgtcggagggcaaaactgaatcgttcagttttgccctccgttattgaaaatgaattaccttgatcagccgttttgcagcatcgtcatcgctcttaacttttcttcatcctgtataatcaggcacccgtcttcccgggccaggattcccgtctctctcagcttcctggcaatgcggcttacggtcaccggatgcatgcccagatagtttgcgacctctacgaaggaaaaagccttggggatcatggatttcccctgtttcttgatgcagtaggtcaggagccacttgcagaactgcgcagttttgtcgccgtccatcatccactggatcttattcaccagttccagataatttaaggtcgttgcgcctagaacgcactgggtgaaatacggggaagaatccatcatggactcaaactgttttgccctcatgctgtagtagacgcagtttgtctttgctgtgatccagaacggggagggagtgatgtagcgctgccagtcataggggaagtgcttcaccagcgcattggcgaagccgaccagccgtttttctccgaaatagaggtaaatatgctcctctccatcatcattgatccgcgtcagtgcggcgattccttcatccagaaaacagatattgtcacagccctcccgcgatggatcaaacagatattgattctttttcgcctcttttcgaactccgtagcgaataaaatcttctctgatctgatatggttccatggtcatcctcccgtataaatctttttttactgatataactatagcacaccttgtctcctgtatccactgaaaaatgcattttgaatcttagcacctgctattggtatgtgtgatatcagtatgttaatattgtgacaataaaacgtactagggggaaataccatgagacaaaagaaaaatatgtatccgtttcactgcctgatcggcatcgcgattatgctcctgtttcgtctgcttccgattaacatgcccaacattacgcctgtgggaaagcagatcttcggcatcttcatcggaacgctctacttatggacgacggtcgacccggtctggtccagcatcctctgtattttcatgatcggcacctccggctatgcgccgatgggagccgtactgaacaccgcattcggcaatccaacggttgtccagctgttctttctgatgatcctgatgaacagtcttcagaccaaccggatcagcgcgtatatcggccgcttcttcctgacgagaaaatttattatcggccgtccgtgggcgtttaccgccatactctttgtaggctccatgctgatagccgcgtttgtaggctgctttgcgccgattttcctgttctggccgatcctatacgatatctttgatgatatcggcatgaagcccttcgaggcgtatccgacaattatgattatcttgattgtcgtggcctgtgccatcggttttccggttccgccttatatgagcaacggcctcgcgctgatctccaactacacaaccgtgtctcagaaccttctgggaacaaccgttactatcaacaacggccagtggctgttcgttgcgctgatttacggcttcgtgtgcagcgcagctgtgatcctcttcaccaaatatgtcctgcatcccgacgtgagcaggctgaagaatctgacgctggaacagctcaacaaaaatccgctgcctccgctgagcagaagacagaaggccgtggccctgatctgtgtctgtttcctgctaagcatgcttctgccaagccttttccccacacttccgggcatggcatggctcagcgccaattccttcggtatggcccttttgttcctggtgatcttatttgctgtgaaaatcgatggggctcctgctatcacaattgaagaaaatgttaaggtatttgcctggggaacgtatttcctggtgacatccgcgatattattgggaggcgtgctgacgaatgagagcacaggagtgactgcatttttaaatgcaatcctttccccgatctttacgggtatgagcccgctggtcttcggcgccatgctcctgatcatcggatgtgtgctgaccaatgtctgtaattccctggtgatcggcatgatccttcagccggtggtagccacctactgcctccaggccgggataaattccgctccattggtatccatcatgggaatctttgtgctctcatgtgccattgcgactccggcggcatctccgttcgcggccatgctgttcagcaataagagctggctgaaatccggagatatctaccgctacaacatcatgtacgtggtgctggaactggtactggcgcttctggtagggctgccccttgccaatgcgctgattcattagatgaaaagatgcggctgctatagctttcccctgcactttatcgtataatgaaagaaatacgatttgcaggagggactatatgaaaaagcaatgcaaaaaattggcggtttatttcatgagcggcagtcttctggtgtccaccttcaccgtggttcccggaaccccgttttccatcgaggcggaggcgcactccgggcgtacggatgccaacggaggccacaaagacaacaagaataagagtggcctgggaagttaccattaccattgcggcggctatccggcgcacctgcatcccaacggcgtatgcccttatcagtcggggactgcctcggaggacaagcagacatcaaagcaggcggagcagaagccggcagcacagccggaaacgaaggcagagactcagccggagacccaggcggctgccattggctggtatcaggacgcgagcggctggtactactgcaaaggggagaaccagtattacaaagacggctggcaggagattgacagcaagtggtattacttcgacgccaacggctatatgaaaacaggctggctcattctgggggacgactggtactatctggcctctgacggccacatggtgaccggggatatggaaatcgacggaaccttgtactactttgagacgaatggagtgctgacagacgattactacgactgatgaagagatggccaggatttgtctttctggaaactttctggaaagtgaattcatatttcacacatatttcacaagttgtacaaaatttatttacatcttctacaaacttacttcataactcttgcgtatactataaacatagacaagaaaaacttgtttaataaaaagactttttttcataactcgccggtggaacccacattccaccggctcctccctttttatgggggatttttttgtttatcatctctgattgtaagttctgaccggcttcccctgggaatttcatatttagaatagaaaagagcatgaaaaatatcatattttatatttgaaatatatcgaaaaaagcagccatttttttgtaactatcagacaaaaaaacggctgctttttttgctttttatccattgacgatacgatccaatctttttataatgacaatatcaattgattctacatttaaaaaagtgattccatatatggaatagaaggaggggccatggaccttcaggaacaaatgaaagagtatagtgctttaaaagcacttcagatcattctggctttagcagagcagaaaggttgggtgaatatcagtgatatcgcagaagcaaccggtttaagcccgagcacggttcaccggattctgcaggaactccaggcatgcggctttgtttcaaaaaacaaagaggcgaggcagtataaactggggatgggcatgatgaatattgccctgaaagtaaatatgtcggattatttgctggaagcggcgcaggaggagatgatccggttaaatgagctgtcgttagagaccattcatctgatcgcgccggataacgataaggcagtatacataggaaagatggatgcaaaaaaccagattcagctgagatccaggattggatggaagattcctcttcaatgtacatcaggaggaaagctgattcttgcgtatcacagcagagaatgggtggacagttatttgaactataacccacttaagcagtatacgaataatacgattatccataaagaaactctgcacagagagctggaattgatccggcagcagggatactcactggataaccgggagcataatccggatatcgtctgtattgcggcaccgatctttggaattgatggaaatcttgccggaacgataggaatatctgctccggattaccgattctcaccggagaaggcctgttcctttgcggaagaggtgaaacgaagcgcagcggcaataacagaaaaattacaggcataggaggacatatggaggactttacttataaaaatacgaaatacagaagtgcggttgtcgtaaatggaatgagtatggcagggccgagagcacacttcagggggatgggcctgtcgaatgaagagttaagaaaaccattcattggaattatcaacacacataatgagatgcatccgggccacgtccatctggataagctggcagagcaggttaaagcgggggtatcggaggcaggaggcgtgccgtttgagattaatacaatctccatctgcgacggttttacgcagggccatgccggaatgtgcagtgtgcttcccagcagggaagtgattacggattccattgaagtgtatgtaaacgcccatatgctggatgggcttgtactgttaggcggctgcgataagattgtcccggccatgctgatggccatgctgcggattaatataccggcaattctggtaacgggcggaccgatgatacctgccgtctatcagtcgaagagctatgcaacttacgaattgaaggaaatggctggaaaactgttaaagggtgagatctcaaaggaagagtatgaggaaatggaaggcatcatgtcacccggacccggttcctgcgccatgatggggaccgcgaacagcatgtccattgcagcggaagcaatgggactgaccctgccgggctgtgcgggagcccatgcagtagcgggcaaaaagaagcgcattgcaagacagagcggtgtccggattgtttcccttgtagaggaaaatatatgtccgcgggatattgtcacccaggatatgctggaattatcggcgagagtatgcgtcagtgtcggcggttcgaccaatatcacacttcattatcccgcaatcgcgagagaaggcaggcttcatatgacaatgaacgagctgggagagatatcaaagacaacgccgtatctggctaagattaagccgtccggtgtgcacaccatgctggatttcgacgaagccggcggagtgggcgccgtgctgaaagctctgtccggaatggcagatctggacctgatgacggtaaatggtaaaactcacagacagaatgcagaccggctgacaagctggaatcaggaggtgatccggactgtggaacacgcctatgcacctgaaggctccattgcagttttgcatggaaatctggcgccgaagggctgcgtcgtcaagcagagcgcggttgtggcgcagatgagaaagcataccggaccagcccgctgctttgagtgtgaggaggacgcggtaaaggcgatttacgaaggtgcggttaaggatggagatgtcatcgtcatacgcaacgaaggtccgaaagggggccctggaatgcgggaaatgctgaccgctacggcagcactggtaggcatgggatattcagaaacggtggctctgattacggatggccgcttctccggtgcgacacggggaccgtgcatcggccatatttcaccggagacgtcacaaagggggcccatcgcggcattgcaggatggagacagaatatccatcgatatcgatggcggcagcctgtcggtggaactgtccgaggacgagatagaaggaaggctgaaaaagctgccggaatttcaatataaaattacagaggggtatctttaccgttatgcgagggaagtttcctctgcggatgaaggcgctgtcttaaagtgaggagaaagtaaatgaagaatataacattgcagggaattacagctccggtactcactcccttttgcgaaaatggtgaagtcaataccgaagagtatgcaaggttaattaagtatatcaccggctgcggaataagagggatttttgtaggcggaaccagcggtgaattcgttaatctcagaacggaagagagggagcgtctcctggctgctgcgaaagaagcggcagaagaggaggtaacagtactctttaatgtgactgccatgaacgagtacgaattgtaccatatgatcgaatgggctaagaaggaaggtgcggatgcggtctctgttaccgctccgtactatcacagatatgatgagaaggcgctgtgccggtactttggaaaagtggcggaagcggcggagggaatgccggtatatctttataatatgagcggcatgacgaataatcccatcacgccgatggtgttgaaaacagtggcagagcagcatcggaatatctgcggagtgaaggacagcagcatggattttatgaccctgctcaactatcaggttgcaatggaaaagatggattttgagctgatcacgggaaatgatgcccaggtgctccctgcccttatggcaggagccgccggagggattatcgctgttgccagcgtatttcctgaactttcattcagcatatggtcgaattttaaagaaggaaacatagaggcggccaaagcgtcgcagaaaacagttttacaaattcgggaactgtttcgctctgttatgccgacaatcgcacataaggaagccttaaaattaaaaggctttgctatgggaccgtctcgttttccgttcagagatctgacggaagaggaaatgaggaagcttaaaaggggcctggtaaatctgggcatgattaagggagattaagtgggaggtttatatggttactggaggatggttaatcgttatttttctgattgcgatcgcaattttactgattacaattattaaattcaaagtcaacgcttttattgcattgctggtaacaacaattggaacaggccttatggtacggatgccggtctcggatatttcgaaagtaatcggaaacggattcggcaatacactggggagcatcggtgttattatcggcctgggagtaatgctgggaagatttttgtatgaatccggtggaattgaggtcattgcggatacattcctgaaaagattcaatggctcaaaatccagaatagcagtggctatggcaggctttatcaccggaattcctgtctttggagacgttgtacatattatgtatgcgcctatggtgcgtgtgatttcaaagaaaacgaaggtatcaatcgtttccctgtgctgtgcgactgtctgtgcgactgtggcgacaggcgcgatggtaataccgactccgaatcccatggcagtagcggaaaatctccagctggactatggtgtcttcttcctctatgctgcgcttgcaggcttgttcggtaccattgtaggcggcttgggatatggcagattcctggattggcaggaccggaaaaatcatcatgaatatgcatttgaggatatcgaggattttgaaaaggagagcagaacatcggctgcgggaagaaaggttccgggctttggtgtggcggtatcaattcttctggttccaattatgctgatactctttggaagctttggacctatgatcctgccggagggcgggacgctcgttaagatactgaactttgtgggggataagaatattgcgatgctgatcggcgttatttatgccgctcttgtttctcttccatatctgcaaaaaccggttggagatgtgatgaacgatgccgccggtcaggtgggcctggtgcttctgattaccggctcgggcggtgcctttggaaagatgcttcagtcaacgggaatcgctgattttatagctgcctcactgtctcagttccatatcccggtactggtgctgtgcttcattatagcccagatactccgctgtgcacagggctcaacaggagttgcgctgattacgacctcctccatgtttgccccattgattgccgccagcgggatatcgcctgttctctgcggtattgcgatctgcgcaggcggaatcggtttatcccttcccaatgattccggcttctgggcgattaaccgtttttacaagatctcagttgaggatacgatacgcgcatggacgattggaggttttataacgggagttgccgcacttgtgttcgtctgcatcttatccgtattccaggcacatctgccgggcttactgtagaaaagataaattatggaattggcgtctcttatatggtctttgatcatacaggaggcgccgcttttatttccaggaacgttcgggacattatgatattgatttgttttaataataatagtacaatttatgcatatggccttagggccgaaaatgggattcaaataggaaaacagccgtcaggcacggcaggggagcagagatgaaaaagcaggaaaaaaacgaaatttccatgaaatggcgaatgataggcatcatgctgatgtgctggctgctgccgttctgcctgatcatcggagtggcgggctactatattttaagcaaccgctacgggaccgtggcgcagggcgtcgtggaccaggtggtctatgacgggcagatctgtgtggaacggctgaattacggcatcaacgcgtcccggaaggcgacctatgaccagacgctggagaaggcgtggagagagtatacccgcggcagcttaagctacggcggcctctattccgcgagcaatgactatttaaataaggagtaccgccagaaccagtgtttttccactactattctgtggtgctacgaggagccggagcggatgaactgcagcgtctacaacaacgcggccggcggtacgtatcagcaggtgcagacctactggagagaggatcatgaaagggttaaggcgtttctctccaccctggacacggcactggggtacatcaatctggacggcaggatctacatggtcagaaacctccttgacaattcgtattatcagttcggagcgctgatcatgcgcctggacaaatcatactgttttggccccctcatcgattccccgcagggggagaatgtcctcgtccgcctcgacggccaggccattctgctgaagggcggagatatcgaagagatgataaaagaaagcagcgccgccgcacggcagacgggatacagccgcaaaaacggaaatctctacgtttatgacacgcagaaggaagagtatttcaccctgtcggtgatgatgcaggcggataaacggattattcaggcgccgttttatggctatccgttcgttgtcgcaggcatgcttttgttcctggtgcctctgcttttgattctgcttcgcgtattcaaccggaatgtcacgaagccgattacggacatgatggagggagccgatcagattgagacgggaaatcttggctatcagattaaggaggaaccggaaaatctggagtttaagtacttgatggagtcctttaaccagatgtccgaacggctgaagtatcagtttgaccacatctatgaggaggagatcgcgctgcgggatgccaggattatggcgctccagtcccatattaaccctcatttcatgaataatacgctggagatcatcaactgggaggcccgcctgggcggaaatgagaaggtatcccggatgatcgaggcccttgctacgctgatggatgcggccatggaccggaagaagcggacctttgtccctctttccgaggagatgatgtatgtgaacgcctatttatacatcaattccgagcgcttcggcaaacggctcaccgtaatcaaggagctggatgaatccatcatgcagtatgaagtgccgcggctgattctgcagcccgttattgaaaatgccatcgaacacggcgtcaggcccagcggccggggaaccgtgatcctgcggggctatgagaaggagggatttctctatctggatatcgtgaatgacggaaccctgacacctgcggaggaggagaagatctgccgccttctgtcgcctgattatgacttcagccgggaaccctcgggaaacctgggcattgccaacgtgaaccagcgtctgaggatcctgtatggggagccatgcggccttacaatagagaaagacgaggaacagcatgtcatcgcacgtcttacgatagctgtccagtagagagcaccagttctgccatttgttgtattttcttgttctgtgataaatgaacaagaaaatacaacaaatggcagaactggttattcatttttgcacccaaatcagcgataataatgacatgaggtatacaaattgcaggaatgcaaagggtgtataaaaaaaacaggaggcaattaatatgaagaaaagaacgatggcattattactggcaggggctatgacaacaaccgtattcaccggctgctccaaacagtccacaacagatacgacggctgctccgaagaccgaggcaggaaccgaggcgaaaacagagggagaggcgaagacagaggccccgaccgaagcaaagaaggcagtcgcattaaacgttatgaccacattcgcaggcgaggatggcaacgctccgaactaccagaaggcagtgaaggactgggaagcttcgactggaaacaccgtaaacgattcttcagcagtttccgacgagaccgtaaaggcccgtgtggcaagtgatttccagatgggttccgagccggacgtactgttctggtttaacggcgcagacgccaactccttcatcgaggcgggcaaggttatgtccatcgatgatatccgcaaggaatatccggagtacgcttccaatatgaacgacgatttaatcgccgcatctctcgtagacggaaagaaatacgcagtgccggttaatggtttctgggaggccatgttcgtcaatacaacagttctggacgcagcaggcgtagctgtaccgggaccggattacacatgggatcagttcctgacagactgtgagaagatcaaggcagcaggctacagcccaatcgcagcggcgcttggcaacattcctcattactggtgggagtacaccatcttcaatcacaacacaccggcaaaccactgtgacattccggaaaccgtagaagatacacagggccagtcatgggtagcaggcatcaacgatgtcaaagacttatatgaaaaagagtacttcccgaagaatacattatccgcaaccgatgatgatacattccttgccttcacagaagataaggctgcattcttaatcgacggttcctggaaagtcggcggaatcgcaggcgcatgccagtccgacccgaatgacccaaccaccatggataccgagaagctcgacaaattcaccgttacttacgtaccaggcatgggagacagaaaagcaactgatttaatcggcggtttatccatgggctactacatctcgaagaaagcatgggatgatccggataagagagaggttgcagtcaacttcgtagagtatatgacttccaatgaaatcgtaccgatcttcgcacagcatacagcttccgcactgaaagaagcgccggcggtagaccagagccagttcaactccttacaggtaaaggcaatggatatgatgagcggcgttacctccttaacaccggctgttcaggatattttccagggcgaatgcagaacgtcaacctttgacggcatgccgcagatcgtaacaggcaaggtaacagcagaagacgctgtcaaggaaggcctggagatttaccacgcaaactaaataactgtcaatacaaagccggagacgtaatggcctttcgtctctggcttttttacggaaaaatagggtgagaatatgggagcaaatatctataaaaacaaaaagccgctgttcctttttctggttccggcgttcgccttcatggcaattttcttgtactatccatttatacagaacatcttaaacagttttaagcagattacagaactgggagccgccagcaagggatggaatgatccgtggtacaccaattacgtgaccatgttccaggatgagaacatgcgtgtggcagtcagaaacaccatcctcatgatggtagtcaccatcatcggccaggtaggaatcgccattgtcctggcgcttctggttgacaatatcagccacggagcaaaattcttccggactgtctacttcttccccatcgtcatttcagccactgcgttaggtcttatgttcaatctgatcttcctgtacgacaagggcatggtgaatcagctgctggagagtctcggcgtcaccgaactcatcgactggaaaggcgagaagctggcgctcatcacgatgatgctgcctgttatgtggcagtatgtgggcttctattttgtaatcctgattaccggactcaataatatatccggcgaactgtatgaggcggccgctatcgacggtgcaacaggattccagaaagtaagatatgtctccattcctctgcttcacaatgttatgtgtacctgtgtggtcctcggcgttaccggtgcattaaaggtattcgacctcccatggaccatgttcccgaagggaattccgctgggtgagacatggctgaccggcacatacatgtactaccagacctttaatacgaaaaatgtcgattacagctccgccatagcggttctgatcgtagttcttggaattgtgacggcgaaagtgatcaacacaattttcaaagagaaagattattaggaggggattcatcatgagcagagggaaaaaaatatcgctgggaagtgtggtaatctacatcgttctgggcttctgggcacttaccacgatttatccgattttctgggtcatcatcaactcctttaaggcgaagggcgagatcctttcgaactcctttgcacttcctacaggagcaatgtttaccctggccaactaccggaccgcatttgagcgtctcagtattttcagcgcataccgcaacagtatgattatatccacttcggtggcggctatcgttatcgttctggccggcatggcatcgttcggcctggtccgctacgagttcaagcttcgcaaaccgcttaattcactggtggtggcaggcatgatgttcccggtattctccacaatcattccggtataccgtatgctgagttccgcccacatggtcaatacggagagtctggcgctttccttaacgagcgtgattcttccgcaggtagcaggcaatatgtccttcgccatagtcgtactgaccggctacgtgcggagtctccccattgaactggaggaatcggcctatctggaaggctgtaatccattccagatcttttacaagattgtagtgccccttgcaaaaccgtcctttgcgacagtagcgatcttttccttcctctggagttataacgatctgtttacacagatgttcctgcttcgtcttccgcagcaccgtgccatcacgcgtctgttaaacgagctgacttccaatgaaggaacgaacttcggccttatggccgcatctgtggcattggttatcattccgatcctgattgtctatatcttccttcagaagtatattatcaagggtatgacggccggcgctgtcaaggggtgataaagggaaaattattttcggggttctttgaaacgcccgaatatggtatactgatagcagcagagcgtttgtaaaaatgacgttcggggaagagtgggcagcagatgtatagagtggtgattatagacgatgaaccgattatagtagaaggtatttccaaggtggtgccgtgggcggattatggctgtgaagtgacagcgaccgcctgcagcggcttagaggggctggagataatccgaaagctgcggccggatattatctttacggatatttccatgcccggaatggatgggctgtccatgattgcggcgctccgtgtggagttcccggagatgatgatcgctatcctgaccggttaccgggactttgattatgcgcagaaggccatacgcctgggggtgaaccgtttcctgctgaaaccgtccaatatggatgagatcaaggaagcgcttcagttcatggcggatacgctgaacaaacgaaaggaacaggagaacgctttaaagacgcagaacacggcggaagtccccggttctccggcagcagaaccggaaggggctgtggagcaggagactggcggtaatgaagattcatcggaacataatgccggaagctttattgtaaagacggctctcaagtacatggaagagaattatacccagaagatcaccctggctgaggtggcggaaaagacgtatgtcagccagtggcatttgagcaagctgttaaacggccataccgggaagagcttttctgaactgttaaaccacatccggatcgaggaggcaaagaagctgttaaaggacccgtcgcttcgaatcggtgatatctcggaagaggtgggattcatggatgtggcgcatttttccaaggttttcaagaagctggaagggatatcggcgaacgagtatcggaacagcaggatttagcagaagaatttaattaaagaatttaccagaagtcagggcgctgtagaaaatgattattttctataacgtcctgttttctgattgtgaaaattgcataaactgtgttatgcttactataaatggcaaattatagcataatctgcaaaaacagaagttgccatgaactgcgaaagagaggggaggaatgggatggagctgcttcacctgcactatttcagagaggtagccgccatggaaaatatcacgaaggcggcaaagaaactttacgtatcccagccggcgttatccacggcgattgccaggctggagaaagagctggattttctgctgtttgaacgaaaagggaaccgtattgagctgacagaggcggggcgctgctttctggagtacgtaaacagcgcgttttcacttctggaagaggggaccttaaaatccaggcagatagcaaaccgcaacaatcggcgcatggtgatcgcctccggctttggggtgctcagaaacatgctggatgattaccggaaaatccatccggaatgcgaggtggagctgaagttctgcgacacagaccagatccacgccatgctggccagcggcgacgcggatgccgggctgaatctgggggaaatacttgacagccgcctgacgagccgtgatcttatggtgggcaggtattacatagctgtgaacaacacgcatccattctggggcaggaacagcgtcacgctcaaggatttaaacggccagctgttgttctgcagcaacatcgccagaacctttgaaaccggcatggagatctttcaaagggccggggttagctgcaacctgctgaagctggatgagcgggatgtcctgttctcggcagcgagaaaggggctgggaggcgtattctgcatgcccatgtttgaggaaaataaatcggtggagacaaagcaggaggatgcaggtccgaccgacagaatctactttattcccatcagcgactgtgaggcaaaggcgagtgtgacgctggtgaccagaaaggatcactattacacagccgagaatcaggattttatccattttgtgacacagcgttttttaaggaatcagaacgccttgaacagcgatttggagcaacggggaattcctgtatggaagtgaccggaatacggcggtaagagcgtatacagcagactgacagcaaaataccagatgcaggagccagtggaaaaggctcctggtatctggtatttttatatagcagaaaagtgatttttgcaagtataatccaaaagttatacttgctattccggttttggaattttacaggagcgctcagacatggtataagtaaaaatagataataaatgtatcgtaataaaagagaaaatagaaaaagtgcataagcggtgagatacatcaatcagagaggagtaacagaatggcagaaacatttttgcccgactatacaggctttgtgggtaccacttcaaccggaggaagccgggggatttaccggatcggactcaatgcattaacgggaaagatccgtgtgatggatacgaggcccatgtatcatgcgggatatttgaccgtatcgaaggacagaaggaatctttatgtgctgagcgaggggatgacctttaagggaagagccagcggcggcatgacggcctatgacataagcgatgggaaatttgaagaacagaactgggcggtgacggacggccagcgcccctgctttgtgtgctgtgatgacaacagagcggaaatctatgtcagcaatttctatcggggaacgatggaggcttacaggaggcaggaggatggaaggatcggtgagcggctggcctgcgtagcatctctcgatacgactccggtggggccttttctccactgtgtgatgaaatcgcccgcaggcagatatttagcggcggtggagctgatcgggggaaggatttatatttacgactgtgaagatcggtacaggatcatctggattgaggagatggaggcacactccggacccaggcatctgaccttcagcgaagacggccggttcctctatgtgaaccggcaggatgatgagatggtttccgtctactcctttacaccggaatttgagaggaagctggcccctgtgcagactatttccgtacggacttccggtatgaagggaagaacagagccggcggccatacggctgtgtccgggaggaaggcttctggcggtcagcaaccgcggcatgggacgagaaaaccgggaggattccatttcgctatatggtgtggaggcggagacgggccgtctcacactccggtcagtggtaaagacgggcggagagatgccgagagacatgaatttcacgcctgatggaaaatatctggtggtggcctatcagtttcagggatatctcgacctctaccgtgttgagggggagacgctggtttacaccggggccggctgtaagattccgtcccctgtgtgtatcgcattttaggaggtgaggatgatggacaattctgtggaaaaccgtttataccgcctggagaccagagcggaagtggaaaatataatagggacatactgccatctgctgtttgcgggagagggcggacaaattatggatgagctctggtcccggtcggaggaggtaagcatcgagatcggggcttcgggcaggtattccaccagggaaaaggtggcgacctactatcagaaggaccacattgccggcaaatttacgctgctgcttcccgttacccctgtcatcgagacggcggcagacggcagatccgccagggggatgtggtttgtgctggggctggactccgacgcgggtgatctgggcacaggagacccggaagaaagagcacttctcacctcaaagacagcggatggaaaggcatatcgggcggaatgcgccgtctggcgtctgggggcggactttatccgggaaggggaacagtggaggatttttcatcttcatcagtacgatctggtgcgttttccatgcggtagcgactgggttcgttttgccgaggagcgctatgcgacggatggaatacggctggacgccatgttccggtccaatctcccgtttgcagaagaccgtgctccggaaaatctggccaattcgccgacttcctatcactggcagtaccgcgtggacggaagaacggagaaggaaccgaaggtgccgaagccgtatgagacatactcagaggcggaccggtattaagaagagaaagcggaaggcctggtgctgcattacgtaacgcactgtgaagtgcaggatccgcgccttgctgaataaattaagcaaaaattaaaaggaggagtttaacaatgaaaaaactgggggcattgcttcttgccgcggcgctggtcatgagcatgacggcgtgtggaggcgggaacaaaaatacgggagaaggcacggcggcgcctgccggagaaagcagcacgaatgccggaacaaaagccggtgaaagcggaggggagaagactctgaacgtaggcactatcaacgtactcggcacatttatgccgggaagcgaaaatgaagtatgtcactggggctgttacctcgtttacgactacctgttctattatgacgaggacaacaatcccttctccgatattttaaaagagtggcactatgaagaagacggcaccacctttgtcatggagtgcagagacgatgtctactttgcaaacggcgaccagatgaccggagacgatgttctcttctccataaagactctggtggaccgggagacgaaccaggccgcgtactatgcaacggttgactgggataagtcctatgtcagcgaggacggatttaccgtatatctggcgaatacacaggaattcggccccggcattatcaacatgggcgtcgtatacctgctcgatcagtcatggtgcgaggaaaccggattcgacaacattgatccatggcttaacgcgcccaacggctccggaccttatgaggtcgctgaatacgtgacagactcctatgtcactctgaagcgccgcgacagctactggggcgaattcacaggcgcagacaccgtgaagatcaatcactatgcggaggattccgccatgtatatggctctggagacaggggagatcgatcttgcgcttaacatcgcggagagcgattacagccgcgcgctgaccgatgataaaattgcggttatgacgacccatgagggagaaaatatccttttggctctggacaataacaatcagtacatgaaggatgaaaatgtgcggctggcgattgcttacggcgtaaactggcaggacgttgcagaatcggcccgcggggagttagcggaggtgcctgggtccatcatcacatcagtaagcccctattacaaggacgccggtgtctatgagtatgatctggagaaggcgaaacagtatatggaggcagcaggttacgtgacagatggctcaaccgtgaactttacactgaatatgacgactgtggatcaggcggttaagaccaatgcagccacggtaattcagttttacctgcagcagctgggcatcaatctgcagatgaacttcaccgacttcccaaccgcgttttccgcgtggctgacagagggcggcactgacttgaatttccaggattctgataccggctccgtatgcggggaaccctatatatcccttcggttcttcccggccgaactggcgacgttcccatttgcggccatttcagatgagacatttgtgacactttataaagaagcaaactatacgacggatgacgatgtgcgcaaggagaaatacgcagagcttcagcagtacgttcacgaccgcgccatgatcatcccgctttatgagtctgtggacgctgtggcctacaatccggagaagattgagagcgtcagcctgcacagcgcggtaagcgcaaacctgcgttacgtgattctaaaataacagggagtgaaacgaggttgacgaaatggctaaatatatcttgaaacgaattttgtggatcgtaccggtctgcctcggcgtgctgctgattgttttcagcatcagttactttgcgccgggggatccggtcatgtccatgctgggagccagcgggtacacgccggaggcttatgccagcctaaagcatgaactgggactggatcagccgttctttgcacagtatttccggtacattgtgaatattgtgacgaaatttgacttcggcaattcctatacctatgggcacgcggtcagcggagaaatcatttcccgcatcggcatcaccgtaaagctgggagtgctgagtgtcattgtcaccacgctgatcggcgttcccttcggcgtgatctccgccacaaaacagtattcggctatggattacagcgtcacggtaggctctctgtttttcgcggccatgcctaatttctggctggcactcatctgcattatcgtgtttgcgctgaagttaaaatggctgccggccaccgggatgggcaactggagatacatggtgcttccagtcctggccaactccatgggaaccgttgccaatgtggcccgtatgtcccgttcgtccatgctggaggtgatccgctccgattatatcaggacggccagagccaagggctgcagggaaaatacggtgatctggcgccacgcgctgcacaacgccgtgattccgattctgacagtggtaggcatgcagctgggaaccgttatggcggggtccgtggtgatcgaaacgatttttaacatgcccggtctcggttcctatctcctgaccggaatctcgggccgggactatccggtgatcaacgcctgtgtcctgattcttgcattctttatctgcatcatgaacctgatcgtggatttgtgctatgcgtttgccgatccaagaatccgttcacagtacgtatccggcaggaagaaaaaagcaactgcaaaggaggggtcataatatgtccggaagaaagaaacaagaaacttacatacagtctctggaagggatgacccgtaaacacagccagtggcgcgatgtgatgcaccgcctgtttaaaaacaggcttgccatcgtaggtctgattctggtggcggccgttctctttgccacaatctttgccaactttttaaccccctatgattacaacgcccagtccttcggtgaccggtttgtctatccgtgcctggcccatccatttggcacggatcagtacggccgtgacctcctggcgcggattctgtacggcggccgggtgtccctgatcgtggcactgattgcggttgtcatttccctggtgataggggctgtgctcggcgcggtggccggatatttcgggggaatgtacgataccgttatcatgcgtgtgattgacatcatcatgtccattcccggcctgcttttggcagtggcgatctcagcggccctgggaaccggtttattgaataccggaatcgcggtcgggcttgccagcatcccgggaggtgcacgaatcctccggtctacggttatgaccatacgggatgagcagtacatcgaggcggcacgggcgggaggcgccggccatgcctatatcatagtgcaccacgtgctgccaaatacgattgcaccgctgattgtggacgcttccttaaaggtcggcatggcgattcttacgatttccagcttaagctttgtcggactgggggtttcagagccgacgcccgagtggggcgccatcttaagcagcggccgcgcatatatccgtgacttctggcctctggtaatcttcccgggcctggcgattatgacgactctgctgggattcaacttattgggcgacggtctgcgcgacgcgctggatcccaagctgaagcagtagggggaggagatcacatgagcttactggaaattaatgatttgaacatacactacgtaacggaacaggcgactttccgtgcggtaaatggaatcgatctgtccctggaggagggcgagactctgggactggttggggagaccggagccggaaagacgacgacagctttgggcattttaaacctgatccccaaccctccgggaaggattgtgggcggagagattctctacaagggagaaaatgtggtgaccatggatcaggcggctctgcggaagctgcggggaaatgagatctccatgatctttcaggatcccatgacggccctcaacccggtcatgagggttggagaccagatcgtcgagaccatcagcctccatatggagtgctcccgggccgaggcggtagagcgaagtctcgatatgttaaaaatggtgggaatcgggccggaacgaagcgccgattatccccatcagctttcaggcggaatgaagcagcgggtggtcatcgccatggcgctggcctgcagccccgcacttctgattgcggatgagccgacgaccgctctggatgtgacgattcaggcacaggtcctggagatgatcaacgatttgaagaaccgcttaaaaacctccgtgctgctgattacccatgacctggggatcgtcgcggagtgctgtcagaaggtggcggtcatgtatgcaggagagattgtggaatacggctctctccgcgacattttcaaggaaacctctcatccgtatacgatgggactgttccgctccattccgtctctgacccggaaggaaaaaaggctgaatcccatcgacggcctgatgcccgatccggccaacttacccgggggctgctgctttcatccccgctgtccctatgcggacgagacatgcagaagctgccatccggacctttcggacacgggaaacggccataaggtccggtgctttcacctggaggaggcgaaaatgggacacagggaggtgaaggccaatggctgatttactggaagtaaaggatttgaaacggtattttaaaacaccgggaggagatttgcacgcggtagacggcgtgaatttcacgctgaaagctggaaagacgctgggcgtggtgggagagtccggatgcggaaaatccacactgggccgcgtggtgctggggctgattgaggcgacagacgggaccgtcttatttgagggaaaagacatcactcatttgaagccgaagaaacggcgggagatgtgtaaggagatgcagatgatcttccaggatccgctggcctccttaaatccccgtatgtgtgtggaagagctgatcatggatcccatgaaaatcgtccgcgcctgccgtgataaggagacgatgcggaaacgggtctatgaactgatggatcaggtgggcctggcgagacggtttgcctactcctatcctcatgagcttgacggcggcagaaggcagcggatcggtatagcgagggctctggtgctgggaccgaagttcctggtctgtgatgagccggtatccgccctggatgtatcgattcaggcgcagattatcaatctgcttcaggatatccaggaagagagccgcttatcctatttattcattactcacgatatgtcggtggtgaagcatatttccgatgaaattctggtgatgtatgtcgggtgtatggtggaaaagagcagttccgacgacttgtttgaccacccgctgcatccctatacgaaagggctgctgtcagccatcccggtaccggatatcgatgtggagaagaaacgggttcttctgcagggagaactgtcttcccccattaacccgaagcccggatgcagatttgcaccgaggtgtccctatgcggcggaagaatgccggacacggcagccggcatttgaagaagtcctgccggaccattttgtggcatgccacaaagcgcgggaaattaaccagctatgataggtcattttaaaagacggaaaagagaggagtaaatcgatggtatttgagaaaatcagcagtctggatcgttatgatttgagaaataaaaaatttacggaggcccttgccttcttaaaacgggagagattggaggaactgccggtcggaaattttgaattgtgtcccggtgtgatcgttcaggtgcagagttacgagacagaaccggcggccggaattgattacgaaacccatgatcatcacttcgatatccattacgtaatccacggtctggaaggaatcggagtgacagcgcgtgacggccttacgggaaagggaacctacgacccggaaaaggacatgggatactgggaggaacccggggacgggagcatggtgattctgcatcctggtgaatacgtcattctggctccggaagacgcgcataagccgcattgtgcggtgggggagccgtgcaggatgagaaaaatagttataaaggtggaagtgtaataagaaaaagtacaaagcgctgaaatttaggaaatgaggaaaagaggaagagaaaccatgaagattttacactgtgatgccagacgagatgagattcagaaaacagtatattcctgcggtgagtttgcatatgaatatatttctgattttgcaaaggatttaccgggcaatgtggcaagcgccagcattgccgggggctgtaccgacccggaagggaatgtctacctggggatgcgcggaaatcccagccagattgtgaagctggcgcccgacggaacgtacataaaggggtttggaggagaattgctgggggactatctgcattttattaagtatacaccccaggacacgatcctctgtactgatacccataatcatatcgtgcgtgaatttgacacggacggaacgctgatccgcgatttcggagaagcaggaaagcccagcgacaccggaatggatatgggaacgctggccaggatgcgcagggacggcaagatattcccgacggagccataccttggcatagtgggaatgtgggccttttatgaggcgcagcgtcgtgtcaagcgggttgcggggccgtttaatatgccgactgatgtggatatgacttccagcggagaatatatatttgcagatggatatgggaaccgggccgtacatatctttaatgcggacggtacttaccgaaagaccttcggcggcgtgggagactgggaaaagccctatgaggacactccgggagatatgctgatcgttcatgcgctgtgcgtggatgcgcgggaccatatctggatctgtgacagagagaaggacgccgtgcatgtgttcgatacggaaggcaacgtagtcggctactgcagcaacaacatgggaatgccctccggcgtggatacggacggcgaatacatttacgtcgtggggcgcgcgggctacctgacggtcttcgacctggatttgaacatggtggcacagctgggaacctttaattccgatctgcgcgcccacgatctggcggccaataagcagggcgatctattcctgttcccaacgcacgcaaatgaggatcaccaggtaattaaactgcgccggatacggaattagcgatagggaaaacggaaaatacagattaaaattaattataagaagaaacgcctcatgataataaatgcgggcgtttcttttgtttacttttttgacgttccctttgcccgtttttcccaaaatcatgacgagacaaaacagtactgcgctatacttttatagcattattgaaacggccatggtataattgtctatatatttttggaagtaagcggcatggtatcggcaatggattattttaatggaggagattttgaagaaattatacgatggaatgattggtctggcaatcggagatgcgctcggtgtacctgttgagtttaaaacgcggcaggaaatagaggagaatcccgttcgggaaatgagggaatatggaacccatcatcaggccaggggcgtatggtcggacgatacaagcctgacgcttgctctggtggacagcattgtaaaatgcagcggtatagattacaaggatatcatggaaagattttcggcatggctgctgtatggagattatacggcggcgggcgaggtgtttgatgtagggaatgctacaggcagggcaatcatgaattatggacacgggactgcaccgctgcagtgcggtatggtatctgaatacgaaaatggcaacggttccttaatgcgtatactgccgatggcattttatctgtatttacatgatcaattgcctgtgaaggatcaaatcaggctgatccatgaagtgtcttccttaacgcatcgccatatgagaagcctcgtgggctgtgggatctatgtactcactgcaaaagaattaatccgggagaaggggactttaaaggattccgtagaacggggagtcaatgcagcgttttcctgttatgatgcagcggggaatccggagacggcggcctatgaaaggctgagaaacataaacgggtttagcgcattgccggatcatgagataaagagcagcggatatgtagttcatacactggaagccgccatatggtgcctgctgaatacggattcctataaagactgtgtcttaaaggctgtaaacctcggggatgataccgatacggttggagcagtcgccggaggtttggcaggtatttattacgggagcgaaaacattccagccgaatggctgaacgcggttgctaagagacagtatattgaaagcttatgtgaaaaatttaaatagtggatggtatgagcagaattcatcgaagcgggtaaaatgcgatgaaactacataacaaaggagctgaccatgaatcaatttgaagaagagtacatcctggtaaacggcatcgagcactttttattacactaccccaaaacctccgacgccccggtgctcctgtatctccatggcggccccggaagctttgaatcgcttttcgcatacgagctggataaagcctggggagatttatttactcacgtacactgggaccagcgcggtgcgggcaaaacgctccgcagaaacaagaagaccggcatgccggaaaatgtggatcagatgctggaagatttacatggcatcgtcaagcatttgcagcagaaatatcgagtggagaagcttgtcatcctgggccattcctggggcagcctgctaggcagcctgtatgtgctgcagcatccggaaaatgttttggtctatatcggtatagggcaggtaatcagcatcatggagaatgaacggactgcatatcaggaagtatcagagctggccaggaaagcgggaaacaaaaagcatatacaggcgctggagcgtatgggggattatccccccgataatccggaattactgctgaagcaacttcccaaattacgaaaaatacaggaggcatacgacaatggcccggtttccggttccggtataggcgagctatttaaaaccttacggcgcagcccttccttccaatggggcgatctcgtcagttttatgcggattatgaaagtcaatcatccgcttcatctgcagatgctgtcatttaatcttggcgaaatcctgccgcactatgaggtgccggttcactacatacttggggagaacgacaacattacgccaacggcgctcagcaaggcatactttgatacgattgacgcacctcttaaaacgatagccatgattccggcagcagggcataatcccatgtacgagcggccggaggaatgcactgcggcgcttcgggctgtgcgtgagaccctgttacaatattatttgggacatacggaaaaaagcttgtagtttcctttgatattcgatataatagatatattcgcctgaaaacagagtcttgagatcaggcgtttatttcgaaagagaaggaagttggaagaacgtatgggtggaaagttaaaagctttatttgcacagacagatatgacggtggggaaaccatggaagcagatcgttatctttacgattcccatgttgatcggcaatatcgcacagcagctttataacacggtagacagtatcgtagtcggaaagtatgtaggagataacgcccttgcggcggttggaagtgccagcccgattttaaatctgctgctggtactttttattggtatatcgatgggaaccagcatcatggtgtcccagttttttggagcaagggacagagaaagcttatcgaagaccatcgggagcacgatcactcttaccgcggtgtcctcgctgatcattatggtcctcggttcggtgacgatccggccgcttttaaagatgctgaacacgccggccagcattatcgactggtgcacctcttatctgctgattctgattgtaggcatcatgggcgtggcatattacaacatgttctgcggtattttaagagggctgggagattcgctgtcggccctggtatacctgctggtagcgacggtcatcaatattgtcctggatctctggtttgtggcgggcctgcagatgggcgtggcgggggtggctctggccacggttattgcacagatggtatccgcggtcctctgtttcttcaagctgaaacggatgacggatgtctttgatctgaaatttaaatatttaaagccggatatggaaaatatcatgacgatcctgcgtctggggcttccgtccggtatcacccaggccatcttctccatggctatggtcgtggttcagtcgctgaccaacagcttcggcgagatggtgattgcggctaacgttatcatcatgcgtgtggatggattcgccatgatgccgaacttctcctttggtacggcgatgactacatattccggccagaatgtaggtgcgagagagttcgaccgggtacataaaggagcaaaacagggaaccatcatcgcggcgggaacgtcagcggcgatcacgggcctgattctgattttcggaaaatatctgatgggtatcttcaccaatacctccgagctggtgacgctgagcgccaatatgatgaagatccttgcggtcggctatatcgccatggcggtgacacagagtctctccggtgtcatgagaggcgccggtgataccatgacccccatgtggatttccatcgtaacgacggtatttatccgtgttccgctggcatacggcatcgctcactttacgaagacaccggagcttccgggcggcagatatgagtgtatctgggtatcccttctgatttcctgggtactgggtgcggtattgaccgtggtattctaccggattggtaaatggaagaataagggactggagtaatagtgggattataagaatcgggaataatacgtgaaataacggttgagtttgaggtggagcgatatggatgaattaagatggtatttatacgatcttgtccgcgagatcatggaaaaacatgggattgaggagacggcctattcgctggagactgtccgggaaggggctgtgtgcctgatcccctccgcccacggatttttggtaaacggcggcggagacgaagagtcggaacaggaagatttttaccgcgggtgccgggagcttttcctgcggattttcagggctgatgagacggcggaaacggccatgcaggaatttttgacaagaacgctggatcttccggttattatgaaggggccgagtgtatcgggcctggaagcccggattcggaagtgtcagtatgagatggaagcgctggagaaaaaggcactggagcccgacggtcagaaatggaaggcgaagctaaacctcgaccgcatctatctggagggccttttaaaaaatttaaaagacaccgataaaaaacggtacgaaaaaataaaaacagaaataatttaatcgggaagtgtataaaaatctctctttggtttaaaataggagtataccaaagatgagtgaatacttatcctcccctttttagtgcggaagccagaaaacgtaaggtttacagggcttccgcattttttatggaaatccggctgtacagttatccttcgagaggatataatgaaacaagatgcggacatcggacgggaaaggcggcagacatatggaaggatcgatattggagcactacaagaacatactggacctggtaccatgtggtatttgccaggtggcactggatgatgatctgacaattttgtatgcgaaccagttttactatgatatctatggctatacttcacaggatgcagaggaaaaggggtttataaatgccagatttattctgccggaagcggattttcagatgatccataaaaaccttttggatcaggtcgtgcgcggcaagacaaaatttcagatggaataccggggagtacatagtacgggaaaaattttgtggctgctggtccagtgcacctacgacccgaatatacccgggagcgtactctgttccctgatggatattgccgaccggaaacggatggaagacgagatccgcatgagcatggaggagagcaaaactgcctttgcactcacggataaatacatgtatattttcgatgtggagaagagacggctttttcagccggaggcaaccgcggaagaattcggtttacctgttgttgcagacaacgcaccgtacagcattgtggagtcggggaccatcgacgaggagagcagacaggaatatattgatttttacgaatccatcatacagggagagccaaaggggcagacagtcgtcaaaaagaggaaacaagatggcaccaccggctggtattccgcgaaatttgcgatgatttacgacagcgaggggagaccccgccgcgccattatttccagtgagaacattacggagcagcgggagaaagaactgacttatcagaaatggagccagcattttaaggcgcaggaaggcaagaccatcggctattatgagtataatctgacaaaagatgccgtggaggcaggggacgatccccctgattatctcaggccatttgaaaaatacacagatacggtgcgttacatcgcagagcggttcgtatatgaaggagaccgggcaagattctataatttctttaacagagataaactgctgctgcgctattataacgggcagtcctccggtaacatggattacttgagaaaaagggacgacggaagcctttactgggtccgtgcaaccgtccagctgattgctgacccatataataacgacgtccggctttttatgatgacgctggatatcgacgaggagaaaacggaaacgctcaggctgcagcgccgggtggaacacgatggaatgacaggagtcttaaaccgcgacacctttatgaccagggtgacagaggcactggaggagagcggcccagcggcacgtcacgcactgattatgctggacatcgaccagtttaaagtacagaacgacagctacggacatcagttcggcgatcaggtcatcaaggagaccgccggaatactgaaacatttcctcagaagaaatgacatctgcggccggatcggcggagatgaattcatggtcttcttaaatgatatcacctgcgagcaggatgtgattcccagaatcgctcagctttgtgacctgcttaagcggaagtacccggaaaaaggagaagtctcctgcagtctgggcgtcgtcttttatccgagggacggagaaaatttcaaagagctgtaccgcaacgcggatatcgcgttgtatgaggtgaaaagggcggggcggtgtgatttcagggtgtatgaaggggaggcagcaagaagcagccttcattcagaaacaggtgtctaatttcaatatctaacaggttgttttcattttaagaaaatatgttataattaatggaatacaaaaaagtttaaaataaggagaccacgaagacatgcttaatagcatcacaaacctaatcccatggaacagcatctggaatccgtacacatttccgggggctcaaaccattgtgatgcttgtaattctggcaatggttgtaaccgtaagtttcacagcactatttttttgcaggaagacagcggcaggagttctcaaaaaagaattgcttctttactggctgttcacaatcttctcagccacgctgctggccagaaaggagacagcagaaccgaggatcaatatggaattgttctggactgtcaggtatgcgtgggaacggcactcaaggatacactggttttatatactggggaatattgccctttttatcccgctggggtaccttttgccaatgaatggaaagatctttaaattctctctgctgacggttttatttgggttccttttgtctgtggcaatcgaagcaacccagtattttttcaggataggcctgtgtgaactggatgatatgtttaacaatacatggggcacacttttgggatattcgatctaccggcttacagtacccggattaagagggcagtccagaatgaaagagattctcaactttgtcagtaaatgtggctgcgcacttataattttagggacagtggtcctgttttttacattacttaaaataaatctgccgggatagaatgtaaaccagtcggaattttcttgacatattaaccaaataatgctatcctaactaagtatgtgccgctcaacgaggtcctaagcgtccggcttcccggaccaccgaaattggcgagtaaagaaaacaggaggtgccatatgtacgcaattatcgcaacaggtggcaagcagtacaaagtatcagaaggtgacacaatcaaggttgaaaagcttggtgtcgaagcaggagaaacagtaacatttgatcagattctggttgtgaacaacggagaactggcagttggatgccctaccgtagcaggagctactgtaacgggtactgttgtaaaggaaggcaaagcaaaaaaggtcatcgtttacaagtataagagaaaatccggctatcataagaagaatggtcacagacaggcttatacacagatcaagatcgataagatcaacgcttaataagggggactgacaaatgttaaatatgaatcttcaattttttgcacataaaaaaggtgttggatctacaaagaacggcagagactccgagtccaagagattaggcgccaagagagcggacggccagttcgttttagccggcaacattctttacagacagcgtggtacacatattcatccaggcatcaacgtaggccgtggtggagatgatacactgttcgcaaccgtggacggcgtggtcagatttgaaagaaaaggcagagacaaaaagcaggtttctgtttatccaagaacaatcagcgaataataaagtaaaatccctgtgcctggcatggggattctttcatttccaaaaaaagttggtatctccctgtataaaaaaatccagaatgggaattataatactatcaacaaaagaaaaaagaaatacttatcctcccctttttagtgtggaaggctgaaaaacctcgagtttatgcagctttctgcacttttttttgattccgtgtccaaataatcaaaaaacgttttgcaaatttgtcaaagttgttatatactgattcatggagtattacagaaataagagataaaaggatggttgagcgatgactattttagaaaattggagaaccctggcgtatggcgatgggctggatgataaagcaagggaagagttatggtctaattacttcgtagtggagaaaggcatctatgagcagattctctccgcgccggagactgtagtggaaggaactgtgaaggaactggctgaaaagtacggtactgatgttcagaccatgacaggatttttagatggtattaatgagagcttaaagggatatgagaacccgatcgacaccatggacgaggatactgttgtaaagatcgagatcgatccggaaaagttatattacaacatggtagaggcgaaagcggaatggctttacggtcttcctcagtgggagcagcttcttccggaagagaagaagaaagagctgtacaagaagcagaaagcttccggaaccattgtaaagggaccgaagatcggaagaaatgatccatgtccgtgcggaagcggcaagaagtataaaaagtgctgcggaaagaacgcatagtaacgcaaactgataccctgcatgttatatgcggggtatttgattgttaagaggaggagatgcagatggaggcctataccggatttgcagaggtgtacgatacctttatggataatattccatatggagaatggtgccggtatctaaccggacttttaaagaaatacggcgtagaagacggcctggtcctggatctggggtgcggaacgggaagtgtgacggagcttctgtctgagaaaggctacgacatgatcggcgtcgacaattccgaggacatgcttcagatcgccatggacaagcgcgccgcctccgggcgtgatattctatatctgcttcaggatatgcgggatttcgagctgtacggcacggtggcagccgtggtcagcatctgcgactgcatgaactatatcttggaatacgatgatctggtggaggtattttctcttgttaacaattacctggacccggaaggtatttttatttttgatttaaacacaatctataagtatgaaaatgtgcttggggaatctaccattgcggaagaccgggaagagagcagctttatctgggagaattattacgatcaggaaaccatggttaatgaatacgatttagccctgtttatccggatggaggacgatctctaccggaagtatgtggaaactcactatcagaaagcctattctctggacacggtgataatggcacttaaagaggcgggaatggactttgtggcggcttatgacgcatttacggagaatcccataagggaggacagtgagcgtatctacgtcgttgccagggaacgcggaaagaaagaggaagaacgatgacggattatattgtacgagccacagccggagaccatcaggtccgcgcatttgcggctacaacaagagaactggtggaacatgcaaggcatgcccataatacgagccctgtggccacagcggccttaggacgccttttaacggcaggagccatgatgggtgttatgatgaagggcgatgacgatttactgacccttaaggtacaggggagcggcccgatcgaaggcctgaccgtgaccgcggactctaagggcaacgtaaaaggctatgcctttaatccgggagtcatgctgccgcccaatgagaaaggcaagctggatgtgggcggagccgtgggagagggcgttttaagcgtgattaaggatatcggcttaaaggaaccgtacgtaggtcagacaattctggtcggcggagagattgcggaagatttaacctattactatgctacgtcggagcagactccatcctctgttgcactgggagtcctgatgaataaggacaatacggtgagacaggcgggaggctttatcattcagcttctgccgggcgcgtcggacgagatgatcgataagctggaaaagaagctgggcgagatcacctccattacttcgctgctggatgagggaaataccccggagatgattctggatcatatattaggggagttcggccttgaaatcatggataaggtgccggcggaatttacctgcaactgtacgaaggaacgtgtggagaaagcattaatcagcattggaaagaaagaattaaatgagatgattgatgagggtgagagcatcgaggtgaactgccatttctgcaacaggcattacaatttctctgtggaagaactgacggatatccgcgaccgcgcggtgagataggggttcatagagcgatcttctctatgcaatcaaaaagagccatccgaactcgggtggctctgtctgtaatcatgtaaaacaatcgtacttcttcctttatgttgtttgcttcaatccacgcattaaaaattcgcagtggcggtcacatcttgaaaaaggtacatcgttaagtcaatgattaaaatttggtaacgtttactgcctgaggtcccttagcaccatcgactacgtcgaattctacgctggcgccttcgtctaaagacttgaagccatccatgttcagacctgagtagtgtacgaatacgtcgttaccctgctcgtcggaaataaatccgtaacctttttggttgttaaaccacttaactgtacctttcattgtgatacctccaaaatgaataaaaaaattatagtatattgagctgcagcatctctgcaacttccctaagaatagcatagtttgggaaaggtgtcaaacattttcagcttaaaaaaataagaaatctaaaaaataaaagaagaaagaaattatagtggcactgagtgggaaaagtgtggtaaaatgggaacgatttgaagcgtattctgcgcttttaagaacagatggaggcggccatgacgttacataatctttggggacattttcatacgataacggtgcataaattcagagtcatgaagaattgtttccgggttgggctttataaacaggggctccttcatgatctgtcgaaatacggtccggaagagtttattccaggggtgatttattatcaggggacgaggagtcccaacgctgcagaaagggaggagaagggcttttcgaaggcgtggcttcaccacaaggggaggaataaacatcactacgaatactggatcgactttacgacggatatgtcgaagggactggccggccataagatgccgcttaagtacgtcatcgagatgatgatggaccggatcgcggcttccaaaacatataaggggaaggattacacggatgcatccccctgggagtactacagccatgcgaagaagtatatggttatagcgccggagacggctaagctgctggaagagctccttctgatgctgaaggaacatggagaagagcggaccttcgcctatatgaaggccctgctgaaaaatggtgattattgattgggggaaagctatgaaatgcaacatcagccgcacaaagcggtcttacgagtttcacatggcggaaagccactggcatacgcattatgagttttattatctctattcgggacactgcaagatctttatcaaccatacgctgtattacgttgagccgggggatattatcttcttaaagccgggggagatacaccggaccacataccattcgagtccggttaatgaaagggttaccatcagctttgacggggaatatctcgacagtatgaaggaactgtgcggggaagagaatgtggaatatattttccgtaactcgaaggttaccgttccaaacggaaaccggagcagggtggaagagctgatcagccggatcgaatacgaggagacaggacaggatggattttcaccgcttataaaaagagggtgtttttacgaacttctggtgtcactgtcccgctgtcaggaggcggagacggatcatggccggctggagctgggagaagagaccatcgaggaagctgccaaatatatctacgaccattatcagaatcccattaccctggaggaggtggcggaattaagccacatgagtcccgcctatttctcccggaagtttaaggcggtcacaggttttgggtataaagaatatctgaccaatatcagaatccgggaggcgtcgagacttcttctcaattccggctgctctgtcacagagattgcagaccggtgcggatttggagacggaaactattttggagacgcgttcagaaaggcgaaaggcgtatctccgcgtgcattcagaaagatgcaggggggcgtttaagcgaacgccctctcgtctgcttcctgcctctcctctatttactgcacaggtaatccagcaaatggcggacgtaaccgccgtttcgttcctgttctgcaaactgcctgtcatcatatggaaagtatgtgatccggtccttatactccttttgaagaaccggatcaaagatgggagcaaactggggcagataacagccggcccggcgcgtataacaggtctttgccgttgccttgatgcgggcttccctgtccacgtattcggcgacgctcttatggatcgcccggtcctcatagatcaggtagtagtaatttttgtaatcaggataaaaatacttaagctccccttcatacagatcgacagtggctgtgagctgcccgcccttcgcttcgagatcggccacggaggaggaacgggaaaatggaaccggcacggtatagtcgctttggtaaaccagtttgagggcgtgatattcccggccaaagagatcgttccgtgtcagaagctcctgaccttccagtgtgaagccgtgttccagatagtccggataactgagtatcggcaggataccaggcatcccccggagatcgtcggcattatgtaagagaagcatgtccaaaagcacctgttcgtgcgaaaataaataatccttatatacttcaatcagctggccgccggagtagatatcttcccgcccgacgccgagaaactgttcgatggctttctgtttcatgctctccaggccaagcaggttccggtaagggcggatttttttatagatatccagactcgtcactccggaaaaatcgtaaggcaggtcgtaggcgcggcagcgctttaaaagataaggaatatcgaagccgtccccgttaaaatgcacgacgatagggaaacgtctcagaaattcaaagaaggtgacaagcacctctttctcggcagacacggtgtcggcaaaccactgaaccaggttccaccggccgccctcgtaatagacgcatccgactaaatacaggttggaatattctccggaaaatccggtcgtttctatatcaaaaaataaaaggtcttcccgctttccgagacggtccaaagggtatgtctcagggaaaagcggtgtttcgtgtatggtaatcatcgtgatgtctcctgaaatccgtttttatggagccattatatcataaagaaaaaattcaggaaagacttaaaccggtctttttaagtgtggattttccggaaaaatggatttcttccaggctgtggacggtaacctccgggcaggaaaacagaatatttgttcgattaactgcttgcatatgaatacacggtatgatatgataaaaggcaaagcagagaagaaaaaaaggagactgagcgcgtgatttcttatgtaaagggacctctggtcgatatctttgaagacaccgtgatcattgaagcgggatacatcggtctggaaatccatgtaccgttatccgtactggaccgcttgccgggtattggtatggagacgattttgtatacatattttcaggtgagggaagacgggatgtgcctttatggtttcttaaaccggcaggacttacggatgtttaagcagctgatcagcgtcagcgggattggaccgaagggggcgctgggcgttctgtcggccatgacgcctgatgatttgagggtcgctattatttccggcgacgcgaaggcaatttccagggcgccggggatcggagtgaagacggcccagcgggtgattctggatttgaaggacaagattgatatggcggatgttctgcctgcacagtttgcggcagcggaaggtcccgagatatcagccggaggtgtggccaaagaggcgattgaagcgctggttgcgctgggatattcccagaccgaggcgaaccgcgcggtaggcaaggtggaagtgactgaggacatgacctccgaggatgtcctgaaggcgtcgctgaagcatctggcattcctataaaaacagcaggtagatgagaagatggaacgaagaatcataacgacagaagttacggaagaagataagcggatcgagcccaacctccgtccgcagagtctgaacgattatattggccaggagaagctgaaggccaacttaaaggtgtatatcgacgcggcgaaggccaggggagaatcccttgaccatgtgctgttttacggaccgccgggactggggaagacaaccttatccgggatcattgccaatgagatgggcgtgaacatgaaagtgaccagcggccccgcgattgagaagccgggggagatggcggccatattgaataacctccaggaaggcgatgtcctgtttgtggatgagatacaccggcttaaccgtcaggtggaggaagtcctgtatccggccatggaggattacgcaatcgacatcatgctgggcaaggattccgcagcgcgttcgatccgcctggatttacccaggtttactctggtcggtgcaaccaccagggcgggactcttgacggccccgctgcgggacaggttcggcgtggtacagaagatggaattttatacgccggaggagctggagattatcgtctgccactcggctaaggtattagaggtggagattgagccggaaggcgccgcggagatcgccaagcgatccagaggtacgccgcggttggcgaaccgtctgttaaagcgggttcgtgattttgcccaggtgaagtacaacggcgtgatcacgaaagaggtggcagatttcgcactggatattctggatgtggataagtttggactggataacaatgacagagccatcttaatcacaatgatagagaaattttcgggcgggcctgtggggcttgagacgctggcggcttctctcggcgaggatgcagggactttggaggacgtgtacgagccctatctgctgatgaacgggtttatcaaccgaacgccccgcggccgtgtggcgacggaacgggcgtatcaccatctgggacttgctctggaatagctgcgaacaggaagaaatgtaaaaactcagtgcaggaaaacactttgacatccgtgtaaaatatggtatattatgataagaaagcgatacagcaaaagataacaggagagcatgacatggataccaagcactataccgaggttttaatagatggaagaatatatactctgggaggcaccgaggatgagggctacatgcagcgtgtggccagctatattaatgagatgatcacaacgcttaagaggcaggaaggttttacgaagcagagtgcagagtaccagaccgccatggtagaactgaatatggcggacgattacttcaaggcgagagagcagatcgcgcagctggagcggcttaagcatgagatggaaaaggaagtctacagcctgaagcatgagctggtgacgacccagatgaagctggaggctgcgaataaggaactggcagcgggcagaacttccagacaggcggcatctgccgggaatgcttcggagagtaagaagaacgcaggtcagaccggcggcacagtccggacaggcagtgagaataaggaataaaatcgggggatgtctcatgagcagggagacatccccttattattagaaaaagtttagcagggaggcttacgtgaaacagaaaagagtagagattctcgctccggcggggtcattggaaagtatgaaggcagcagtggcggcaggggcagacgcggtctatatcggcggcagcaggtttggagcccgcgcttacgcggataatccggaagaagaccgtcttttagaggcgattgattatgcccatctccatggatgcagactgtacatgaccgtgaacacgctcatgaaggaaacggagctggcagatttatatgcgtttctggagccttattatatgcggggagtcgatgcggttatcgttcaggatatgggggcgtttgcactgatccgagagcgattcccggatctgccggttcacgcaagcacgcagatgaccataactggagtgtatggagcacgcatcctgaaggagctgggcgcagagcgtgtggtgactgccagggaattgtctctggaggagatcgcgggaattcaccgggaggtggacgtggagatcgaaagctttgtccacggagcgctttgctactgctattcggggcagtgtctgttcagcagcctgatcggcggacgaagcggcaaccggggaaggtgcgcccaaacctgccgcctgccttacgacgtgaaacgggacgggaagactctgaatgggaaggacagccggtatgtgctgagtttaaaggatttatgcaccctggatctcattcccgatatgatagaagcgggaatctattccatgaagattgaaggccggatgaagagtccgcgctatacggccggagtggtggaaatctaccggcgctacacggacctttatctggaacggggacgggccggttaccgggtggatgaaaaggacagaaagcgccttctggagctgtttgaccgcgggggccagacggacggatactaccgccgccataatggaaaagatatggtggtatggaaggaaaaaccatccttccgcgaaggcaaccaggagctgttcgattatctggataagaattttgtggaaaagcagcagcaggagccgatccggggaacggttgttctggagacgggaaagcccgcattgctggagctttcctgcggagactgccgcgtgtccgtgtccggtgatcccgttctggaggcgttaaaacaacccatggacgaggccagaatcagaaagcagctggaaaagaccgggaatactccattctactttgaaacgcttaccgtagagcttgccagggaagtctttcttccggtgcagtctttgaatgatctgcgaagaagagggctggaagcactggaagacgcagtgcttaagcagtaccgccgcgaggcgccgcaagcggtggaaacagtggcgcagatggtggaaacagtgccacagacggtggaaacagtgccgctgacggtggaaacggcggacgaaaagaatcgcggtacggtggagactgccaaccgcagagaaaacggtttggagcgtattttcgtttccctcgagcgcccggactgtctcagtgcagttcttgataatcctcatgtgaagcgagtctatgtggacgcggctgagttcgggccggagctttggaaaacgacggtctcggcttgtcacgacgcgggaaaagagtgtatgctgacgatgccccatatcttccggaccgaggcggaacggtatttcgaacgcagtcagaaggctttttgcgaagccggatttgacggagtgctgatccgttccatggaggagatcggatatttgaaggaacatggcccggaaatcccctgggttttcgactatgggatgtatggaatgaacgacagagcggaatcctttcttatgaagatgggtgccgcagagctgacctggccggtagaattaaacgagagagagctttcccggctctccaaaccgggcgagttgattgcatatggccgtctgcccatgatggtgacggcgcagtgcattcaccagggaacggagaagtgtgataaaaagccggggcttcttatgctgaaagaccgtatggccaaggaatttcctgtgaagaatcactgtgcgttctgctataacacgatctataatgcggcgccggtatccctcctgggaatggagaaacagatcagggcactggctccggcggcggtaagacttcagtttaccgttgagacaccgcaggagacggcggcggtgatccggtgctttacagacagcctgctgtcgggaaaacgggtggaacagccctttggagactttacaagaggacattttaaacgcggtgtggagtaggagcctatggtgaatctgattgtcgatgtttccaggtatttgatgatactgctgattgcggtgtatacctggttgaatttccggtatttttctttccgggacgaaggaaaacaaaagaagatatgcggacgtcagaaccggtgcatgtttctgattcattttctggcatacgggattctgtggctgaaaacggaagatgagcgcatcctcgcgttttatgtggcgcaggtagtattttttctgtgctacatttacgtttaccgcctgttctaccacaatgtttcgcggcttctggtcaacaacatgtgtatgctgctcagcgtgggctttatcattctgacgcggctgtcctttgaccgggcgctgaaacagttcgtgatcgtgctggcggccgcggtcattacctgggttataccgtttattatggaccgggtgtggcagctgtcgaagattccgtgggtctatgggatcctgggactgctcctgctcggcgtcgtgctgattaccgggattagcagctatggagctcagctttccatcggaatcggaggctttaccttccagccgtctgaattcgtaaaaatcagtttcgtcttttttgtggcgaccatgttttaccgttccacgaagtttaagacagtgtgcatgactacgctggtggccgcccttcatgtactgattctggtggcttccaaggatttgggaagcgcattgattttcttcgtaacctacgtgctgatgctgtttgtggctacgggaaaatgggtgtatcttctgggcggagcaggtgcgggggccgcggcttcggtgctggcctatcagctcttcgatcatgtcagggcgagggtgcttgcctggagaaatccatggtcggatattgaaaataagggataccagattacccagtcccttttcgccatcggtacgggcgggtggttcggcatgggactttgccagggaatgcctgggaagataccggtggtggaaaaggactttgtattttccgccgtttcggaggaacttggaggaatctttgccctgtgcgttctgttcatctgcttcggatgctttctgcagtttatgatgattgccagccgcatgaaagcggtgttttataaactgattgcctttggcctgggaacggtctatatcgtccaggtatttttaaccgtgggaggcgtgacgaagttcattccctctaccggagtgacccttcccctgatgagttacggcggaagctctgtgttcagcacgtttattctgttcggagtcatgcaggggctgtatattttaaaacagaatgaagaggaagaaaaacaatatgaaaaaggctgacccgaatcccaaggcaaaccgccatattctgatgattacctatgcggtggcggctcttttcgcaggactggtcctgtattttgccttttttcttcagataaaaagtgaaaatgtgatcaacaattcctacaacgcccggctcgacagcttttcggaccgggtggtaaggggagaaatcttaagcagtgacggaagagttctggctcaaacaaatgtggacgagaacggcggtgaaacgaggtattatccctatgatgccatgttctcccatgtggttgggtattctaccaagggaaagaccggcctggaggcactgggtaacttttatctgctgaccagccacgtgaatctggccgagcaggtgatcaatgagctgtcgtccgttaaaaatctcggggacaatgtgatcacgactctcgacgtagacctccagaaggcggcgtatgacgctctgggcagccggaagggggcggtggtcgctatggaaccggacaccgggaagatactcgccatggtctcaaaaccggactacaatcccaatacgctggctgcggactgggacgctctcgtggcaggcgacaacagcgagggacagctgttaaaccgcgccgctcaggggctctatccgccgggctcgacgttcaagatcgtgacggcattggagtatataagggagaatccggagaatttcagggattatcggttcgactgcagcggtttttttcactatgaggattacacgataaaatgttaccatgagacggcgcacggcagtcaggactttgtccgggcttttgcaaattcctgcaacggcgcttttgcgaatctcgccctgacgctggatttaggaaggcttaagaccacggcggatcagcttctgtttgatacgcctcttcccatcgccattccatacagtcagagcgcctatgcgctgacgccggacggcgatacgtggcagatacttcagacctccatcggacaggggcagacccagatgacacccatacatggcggcatgatcgcggcagccatcgcaaacggcggcactctgatgaagccgtacctcatcgaccacgtggaaaatgtgggcggtgatgttattaaaaaatttatgccccagtcatacggcaatctgatgaccgcggaggagtcggccagcttaacagagcttatgcgggccgttgtaacggaaggaaccggttccgcggtgcgtacggatgcctatacagtggcgggtaagacgggatcggcggaatttgacaaggacaaggagactcacgcatggtttatcggatttgccccggcggagcatccgaagctggtggtaagcgtgatcgtggaggaaggcggttccgggggaaaaacggccgctccaatagccagatcgctgtttgatacctacttttcgagatgacaagaacactcttgcatataagtttaaaaagaggtatactatacccagtctgtgagacacaccaaaaccggaatcccggacagggatgcaaggtttcagtctggaggaattgcaatgatagaggcaacgagctgtggcggtgtggttatttttcgaggtaaaattctggttttatataagaattataagaacaaatatgaaggttgggttttgccaaaaggaactgtagaagcgggagaagaatataaggagacggcccttcgtgaagtgaaggaagagacgggagtcagtgcgtcgattattaagtatatcggaaagagccagtactcctttaacacgccgcaggatatggtggagaaggatgttcactggtatctgatgatggcggacagctattacagcaaaccacaacgggaagagtattttatcgattccgggtattataagttccacgaagcgtatcatttactgaaattttccaacgagaaacagattttggaaaaagcctataatgaatatctggatttaaaaaagagcaacttatgggggaataagaagtatttttgatgcatggaatcgtggatatacacggatcacacgaaaaaatggatgcaggaatgccggagataccggtttcctgcatttttcgttttttagcgtttgctggcggagacatcggcagatggatagtagtaatttctgagttttcgtatatactgtttggtaagactgtctcttaccgtttgcagcatacctcgtgggccggatttccatactttacaggatatggcagaagaggtatactgaatacatgtttgacagaatatgaataaagaagcaaggagataaggcatcatgagcaaagcatatgaaagactggaaaaagtactggaaaagacaatggcgttacagaccgctctgattttgtttgagtgggataatgagacgctggcacccgaggaagccggagcccatacggccagagtgatcggagctttatctgaagagtattacaacatggtggcaggcgacgagatgaaggaagccatcgaagcgtgtgagaaggaagagggcctcacagatgtggagaaagccattgtgaaagaggcgaaggagacgagagaacagcttgtctgcatcccggcggaggagtaccgcgataacgcacagctggtatcggaggctacgagagtgtggtctaaggcgaagaaggagaatgatttcgacaaatttgttcccactctgaaaaaggtagtggactaccagaagaaatttgcctcctaccgcgcaaaggatggcgtaaaactctacgattccatgctggatctctacgagaaggactttaacatggaattgctggatcagttctttgatgagctgaaagaggccatcgttcccctgatccgtgagattaaggagcgtggaaagaagattgaaaacgccttcttgacaggtgattatccggaagagaagcagagagagctggcggaatttctggcagagtacgtgggctttgattttaataagggcgtactggcagtcagtgcccatccgtttacgacgaatttgcacaatcatgacgtaagaattacgacccattacagcggccatgtggacagctccctgttctccgtgatccacgaggcgggccacggaatctatgaactcggtatcggtgacgacctgacacagacactggtgggccagggcgcttccatgggaatgcatgaatcccagtccagattcttcgaaaatattatcggccgcaacgccgccttctgggtaccgctttatgagaagctccagtccattttcccggagcagttaaagggagtcagcagggaacagtttgtggaagccatcaataaggcagaaccgggcctgattcgtacggaggcggatgagctgacatacagccttcacgttctgatccggtatgagattgagaagatgattatcgaggaagacctggatttaaagaagcttccggagatctgggcggacaaatacgaggagtacttaggaatccgtcctgaaaatgcctccgaaggcgtgctgcaggatattcactggtctcagggctcctttggctacttcccatcctatgcgctgggcagtgcgtttggggcacagctgtattaccatatgaagaaagagatggacttcgagggccttctggagagaggggagatcggagtaatccgtgaatatttacgggaaaacgtccatcgtttcggcaagctgaagaccagcagagagattctgaaggatacgacaggagaagatttcaatccgaagtattacattcagtatctgaaggaaaaatacagccgcttatacgatttatagaaaaattttccataatcacaaaaaaacagttgacaaatggcagtaacaagactaaaatcagtaaaaagaattcatataagaacactatgaattggaaaagaggatgattatggaaaagatcagaaagagtgcaatggaactgattggcagcaccccgctggtggagctgactaattatgagaagaagcatcagctgaaggcgtccgtcatcgcaaagctggagtatttaaatccggcaggcagtgtgaaggaccgtgctgcgctgttcatgattcttgacgcggaagcggcgggaaccttgaaaccgggcgcaaccattatcgaaccgacttccggtaataccggcattggcattgccagcatcgcggcgatgaagggctaccgtgcagttctcaccatgccggaaaccatgagcgtggagcgccggaatttactgaaggcctacggtgcggagattgtactgaccgatggcaagaaggggatgaagggagcgatcgcgaaggcagaagagctgagagacgagatccccggatccgttatcatggggcagtttgataatccggcgaacgtgaaggctcataaggagacgaccggtccggagatctggagggataccgatggcactgtggatattttcgtagcaggagtcggaaccggcggaacgattaccggaaccggcgaatatttaaagagccagaagcctgacgtgaaaatcgtagcggtagaaccggagggatctcccattctttccggcggaaatcctggtcctcacggacttcagggcattggcgccggatttattccaacgatcctgaaccaggatatttatgatgagatcattcgtgtgaaggacgaagatgcctatgtgaccggtcgtgagatcgctcagaatgaaggaattctggttggtatttcatcctcggcagcggtatgggctgcaaaggaactggccagaagaccggaaaatgaagggaagagaatcgttgttctgcttcccgatacgggagaccggtatttctctacgccgttgttctcctgatgtatatagaaaaagttcgccgcaggaatgtgattggttcctgcggttttttcgtatcattaaggtgcttttttggtggtatagatggttttacgatacctcatcggcttgttcctatacggctgatggggcatttttatgcatgaagctatgggggtgtgctaaacttaattgcggcagggaaatgtatgagtatgcaacaatacgaatggggaaagaggtagaaggaatgaatggacttaagattaaaagaacagaagttgaagaatttaaaaaatatttaattatggaagagaaaagtaaaataacaattaaaaagtatattcatgacatcggatgctttttaagctatatagggaaaaatccggtgacaaaagagcggatcatcagctacaaggagtccctgcaaaaaaaatacagcgcaagaagtgtgaacaccatgcttgcgtccttaaacagtttctttcgctggctggatcatccggaatttctcgttaagcagttaaaaatacagcagcaggccttttgcctggaggaaaaagaactgacgagacaggagtatgtccgcctggtaaaagcagcgagaaggaccggcaatatcaggctggagatgatcctgcagacgatctgctgtacgggaattcgagtgagcgagctgagtttcgtgacggtaaaggctgtcaggctgggatacgcagaggtgtgctgtaaagggaaaaacagaaggatcatgataccgggaaatctgagaaaaaaactgcttctttacattcagaaaaatggaatcgaaaaaggggaggtgtttatcacgaaggccggcaataccatggacagaagcaatatctggcgcaaaatgaaaggtttagcgaaagaagccggggttctggccgataaaatatttccgcataatctccgtcacctgtttgccagaagcttttacgaaattgataaggatattgcgaagctcgcagatgtgttggggcacagcagtatcaatacaacaagaatctatatgatttccactggagaggaacaccggaggcagctggaacggctgcggctggtggtttgaggggatacaacataataaatattatgttgtaagtataactattagatctgttttaaaccgaaactccatattatactagcacgcatttcgactttttacaactcttaaaatccaaaattccctaaaatatgtgaatgaatttttaaaacaccgttatccgaatgttagcggcaggcgacttatcgtcctatatacaacataatatttattatgttgtttgggcgaaaggcgggatgaaatggttacctataacaggcaggaagtaggcaagcgtctgggctgccgtcgacgtgaaatgggactgaccggggaggaaatgggaagaagaatcgggaagaatggccggtattaccgggatattgagaatggccgatgcggcatgtctgttgagacattaattcttctttctgaggagatgggattgtcactggattatctgatctacggcgcctcgtctgatgacagcgaccggctggatgaacagaagcagattgtaaatagattgtcccactgcaatggacgcattcgcgagggggcggtgaatctgttgaaggtttatttggaatctgttccaaagtgatacggataaaagtaatcccgattatatacaacccgatagatgcaatgaacagataaccttgaagtttttcggggttaggggagaatggagtatgaagtacagtgaaagttaatacaaatgaacgaaagaataatgacaaagcgttaaaccatgcaaatgataatacctcaaaaaaaagacatatcgaacattggaaagtagtcgctttctatctcatcatatatgacataatcgcagtgaatttttcttacttttttggtttgtggctgcggtttgatttgcgtttttcgaatatcccacagacataccttaattcatacttgagatttgcaccgttctatacggtgtttgtgttggttgtattttatgcgctgcatctgtataaaagcctatggagatttgccagctttagtgaattaaatcgaatatttgcatcgagtgtgattactacagtatttcatattgtatgcatcacgttgttcattaagcgtatgccgatttcttattatgtgattggtgcagccatgcagcttgcattggtaactgcaatacgattcgcttatcgctatattacgttggaaaggacgcgaagagagagaagcgttaaggcagttcacaatgtaatggtaattggagctggtgccgcaggacaggttatattaaaggaattaaaaagttcaacagaagtcctgtcaaagccatgctgtgtgattgacgataatcctaataaatggggacgattcatggaaggcgtgcttatcgtcggaggacgtgattcaatcatggaatcggtagagaaatacagtattgaccaaatattattagcaattccgacagcgtctccgaaggacaagcgagatattttaaatatctgtaaagagacacattgtgagttgaaaagtttgcctggtatttatcagctgacaaacggtgaggtatctttaagcagaatgaaggcagtggctgtggaggatttgctgggcagagatccaattaaggtaaatatggaggaaatatttcggtatatcaaaggaaagaccattcttgtcactggcggtggtggttcgatcggtagcgagctctgccgccagattgcaggtcatgaaccgaaacagctaattatctttgatgtctatgaaaacaatgcttacgatatcgaacaggagttgaaaagaaaatacaaggataagctggatctggttgtcttaattggttccgtgcgggacagcagaagaatcaatatggtctttgaaaagtataaaccggatattgtataccatgcggctgcgcataagcatgttccattgatggagacaagtcccaatgaggccataaaaaataacgtggtgggaacctataagacggcctacgctgcgttgaaacatggcacacagcgttttgttctaatcagtacagataaggctgtcaacccgaccagtattatgggggcgagtaaacggctctgcgagatggtaattcagagtatggatgcaatcagcaaggaaggtaagatggatctgcttccatttttgcatgctcatgctaataaagtaattgatggacagattgtgcctgatccggtggaccatatggctgttaatggtttgggagaagataaacggtcggatagtgcaggcaaaggcattagtaaaaacaataaaaaagatatagggtttaacattgctaaaaaaggaaaagacccacagtttactgagtctaaacgaacacaatttgtggcagtccgttttggtaatgtacttggaagtaacggctcagttattccgttgtttaaaaagcagatcgaggcaggaggtccggttacagttactcatccagatatagttcgttattttatgacaataccagaagcagtaagtctcgttatgcaggcaggaacatatgcaaagggcggggagatatttattttggatatgggagatcccgttaagattgatacacttgcccgaaatctaattaaattatcagggtatgagcccggaattgatattcaaatggcatataccggtttgaggcctggtgaaaagttgtttgaagagaaactgatggctgaagagggaatgttgaagacagccaatgaactgattcatataggaaaaccgattccatttgataaagaggtgtttttaaaacagttggagaatctcgctaaggcaagttatgaaaatagtgattatatcgtcgacatggtgaggaagatagtaacgacatttcagcccgtgggggacaagcctacgggaaatgaaattgtaagaaagaatcagattagcagtgccatggcagaggcggcggttacaaatatgactgaataacaagaatatgcagaagaactttctgcataaagcattatgtacaaagtggctgtctatagtaagtaatgtggaaataaaagcaatatgtcaccagggaaatattaatgcgatttatttgacaggagcagagaatatatggagattggaagcgaattctgggaagcggattccttaactggaagaaaaaaatactttttatctggaagaacggctttggaatatatcattagggatattctggaggattataggatagaatcggttttgctgcccggatattgttgccatacgatgattgaaccatttagcagacatgggatttccgttcgcttctatgatgtgttctacgataagagcagggggctttgtgcagacataccagaacgccaaaataatgagatattttactatatgacttattttggcttttcaaatatagctggagttaatatgaatgaaatcaggaaagcgtatgacgtaattattgaggataaaacacattcctggcttgagaagggcttggagagttatgctgattatacatatgccagctaccggaaatggacaggattttacgggattgcggaagccaataaacgagtcgggaatttcaaaccaatagaaggtggtattggcgaaacttacagcaaaatgcgaaaaacagctatgtttatgaagaagagatatattgaggcaggaacggataataaggagttatttcttgccaggttcgatgaagctgaggcatttctggaaaaagattatgtcggatatattccaacagaagagtgcctgctgcaattggtcaatacagattttgagtttataaaagggcgacgaagaagaaatgcggatattttactctgggggctaagcggaatgcggagctgcacactgttacataaaagtagaaatgaggatgatacgccgctgtttgttccaattcttgttaatggaaatcgggatgcgctgcggaagtatctgattgacaatcaggtgtattgccctgtgcattggccgctttccgattatcatcggagattaagtgaacgaggaaaaataatttatgaagaagagctttcactggtatgtgaccagcgatacggggaagaggatatggaaaaagtagtcaagctgataagagactattttaacgaaaggacttaagcaaagatgataacagagattggagtcaataaaagaacattggaataaaacggtttcacccttttgcaaattacgatgttttttatctaaataaatatgtcttctcgtttatgaaagaaaatgaaagcaatggagagccggtactgctgtattatgtaaatggttcagacagggcaatgaatgtactttttaaaagggatatgtggttgattatgatgctttaagaaagcattttattgaggaagagattgtggagtaaaaatgtgaggtaaacgagtaaatggtaaaagtgtttatgacgaatatctagcgttgtaaggtaaattgaataaggcattcccaattgttatttatacaggaaagaggaaaagaatcatgtttgttagatcagagaatatgaagccctttgaatcaaaaatatggctggcttcacccacaatgcacggtgatgaaatgagatacgtgatagaggcgtatgaaacaaactggatgtctacagtgggagttaatatcaatgaagtagagcgtattgcagcagagaaagcagaagtaaagtatgccgtaggtctgtcttgctgtacagcagcattacatctttgtgtgaagcttgcgggggaaaaattgtatggtaaatcagcaaatggtcatggcgctgttgaaagtaagcgtgtgttctgctctgacatgacatttagtgcaactttgaatccggttgtgtatgaaggcggtattccggtgtttattgatactgagcgtgatacctggaatatggacccagttgcactggagaaagcgtttgagatttatccggaagtaaagcttgttgtagcagcgcatttatatggattccctggaaaaatagatgaactgagggctgtatgtgacaaacatagtgcgctgctgatagaagatgcagctgaatctatgggagctacatacaaaggtaaacaaactggctcttttggtgattacgcggcaatttcttataatgggaacaaaattataaccggttccagtggtggctgtttacttacgaatgatctggaggttgcaaacaaagcacgtaaatggtctacacaggcacgtgaaaatgctgcctggtatcaacatgaggaagtcggatataactatcgcatgagtaatgttattgcaggtgttgttcgtggtcaatatccatatctggaagaacatattaaacagaaaaaggcaatttgggagagatataaagaaggctttaagaatttgcctgtatcaatgaatccgtttgaggaggataaatctgttccaaactactggctaagtgcgatgatacttgataaagatgcaatgtgtgaacaggtgcgtgacgacagtacagctatgtatcgtccagaacatggcaagagctgtccaacggagattttagatgcaatcgcaggtatcaatgcagaagggcgtccaatctggaagccaatgcatatgcagcctatgtacagaatgaatgcgttcattaccgctgctggtaatggtagagcaaaaacgaatgcttacattgctggtagtacagaggatattggctctgatatctttaaacgtggtttgtgcctgccttcggataataagatgactgtaaagcaacaggatagaattattgaagttattaaaagatgttttgaatgataataatgctgtgttttgaggagataggattatgaaaaataaccaattatataagaattatataaagcgtataatcgatattttggttgcagttacatttattgttttattctggtggttattattaattattgctgtattggttcgaattaatatgggaagccctgttctctatactacagaaagagtaggtaaagatgagaggatttttcgtatttataagtttagaagcatgaccaatgaagtcgatgaaaatggagttttattaccaggtaataagcgtttgaccaaatttggtgggttattgcggagtacaagccttgatgaactcccgtctctgataaatgtgttaaaaggagaattgagtattgttggacctcgtccacttcccgtaaaatatatgccttattattatgataatgaaagaatccgtcattctgttaatcctggtcttacagggtgggcccaaattaacggcagaaatgcaattacatgggatcataaattcgaacttgatatagagtatgttaataacatttcatttctatttgatataaaggtgattttattgacggcgtggaaagtaatcaaaagaagcgatattattcaggatgaccagcaaacaggaagtctttatatagttcgcaaagagatgaaccgtgttgagggagattaaaatgagtactttaaataagaagaaaattttggtaattagcagcgatagaaatgatattgcttttgttgaagctgctcatgaaatgggactatatgtcatttgctgcgaccgttataaagactggcgtgtaagcccttcaaaaatgattgcagacgaggcatgggatattgattactcaaaaacagaagagatagccaagaaatgcatagagaataatgtagatggtgtgattgcggggtatggtgaagatcgagtaacagctgcgtgcagaatttctaaaaaaattggaaaacctttctatgcaacagaagaacaaattagcatgacaagggataaaagattattcaaaaaaatgtgtgaaaaaactggagtcccaacccctaaagattattcgctaagtggtgatggcagtgaaaacggatttgatcaaattgtatttcctgtcattgttaagccatctgataatggcggtagaaaaggaatcagtatttgtaataatgtcgatgaattaagaaccgctattccatacgcattagattattcagcaaagaaaaaaattgttatagaggagtatcttgttggaattgaattatgtgcagtatatacattttcagatggatatatcagcttgtcatgccttaatgacaaatatatctcagaagatactgggggagcaaaactatgtgatgcagtgcttacaccttcaaaatactatgaaaaatttgttcaggacgtccatcctggaattgtaaaactgatcgagacactgggactcgaaaatggtatggctaattttcaactgattgcaaacaaaaatggtatctatgcttttgagatggggctccgtgtaaatgggaatgacgattttaaagtgattagaaaaaataatggaatcgattttatgaaactgataataaattattccattaccggtaaaatgggaaatgatttggctcaggatgatcctcggtttgagagatattatggaacattttgtgcatttgtgaatgcaggaactattggaaaaattagtattggaaagattacagaaaatgaaaacatttatgatatcacatatttacatagtgagggtgatgttgtcgcaaatacagggacaaacgcacataaggcgatgatgttcaaatttgtcggtaaaaccattagagatattcaagatacaatttcgtttattcaagataatcttatcgtccacgatatacaggggatgaatatgctgatgaaaacatttaatgtaaaaagattggattaatgatatgcgagagataggaagtgaaattggggctatttccgtgattatattggagaataactttttacttttttagaagtgttcaaaagtggtgcggttgctggacggatggatatgcatacggcaactttaaatatggtgtacagatgtctgactgtaatagttcattcactaaattccagatatggagtatatatgcaaaattattaagagggggatagaagaatgttaaaagtatatacattagaggagagtaataaatgggatacagttgttcgttctttttctgagtatgatgtatattggctaagcggatatagtaaaggatttaaattacatggcgatggagaaccgttgctattttactacgaaaataggcatatacgtggaattaatgttgtttttaagcgtgatatatcaaaagttactttctttaaaggaaaacttcctgaaaatacatattttgatttttccactccctatggttatggtggttggattatcgaaggtgaaggataccatgaattgtttagtacatttgaagattggtgtagaaaaaacggtgttataagcagctttgtcagatttcatccagttgtgaaaaactacatattttcagaggggatatgtaacattattccgttgggacaaacggttgctatggatttgagatcgccggaaattatatgggaaaatataagtagtaaaaatagaaatatgatcagaaaagcagaaaaatctggagtgaaaatttttagtggcagatcggaggcattatataaagaatttataggtatttataatgcaacaatggaacatgacaatgcagatgattattacttcttcagaccagaattttacaatagcatttgttttgatttgcctgaaaatgcacaaatattttatgcagtaaaagacaatgaaatgattgcagcgtctatcatgattgcagcaaatggatatcttaattatcatttatctggattaaaatatgaatatcgaagtttggcaccatctaatttgcttttgtataaagctgctttatggggctgcgccaatggatacaaaacatttcatcttggaggcggggtaggatcacaagaggataatctatttaagttcaaaaaatcatttttcaaaggcagcgatctttgtcagttttatatcgggaaaaagatatatattcaggaaaaatatgatgagctgataagtatgagagagccaattaatagtggattttttcctgaatacagagcctgacttttgagaaacgactgtatattttattattggatcaggaggcataagaagatgagagtggcatttattgttcctttttataaggttgaaaaggaatatataaaacaatctattatgagtattattaatcagacatataaagatttagaaataatattagtggatgacggctctcctgacgaatgtggagcaatatgcgataaatatgcatctatggatgagcgtattaaggtaatacataaaaaaaatggtggattatctgatgcaagaaactcaggaatagatatagtaacagcagaatggattacatttgttgatggtgatgattgggtagacgaaaattttatagaacaatttatactgtatatttctgaaaggcatgatctcgcagatatctattatttttccggctatagaaattttcctgataaagaagtcaaaggcgttccttattttgaaacaggtcgaacatttagtacatatgaggaacgagaatttttacaaagtatgtgtttaacaaatcatgtttctaaagatggaaatagaaaaggcattacaattagttcagcgtgggccaaaatatacaaaactgattttattcagcaatataaactaaaatttcctattgttccatatgatgaggacagtttattttatgttgaatcaatagaagttgcaaaaaaaatagaatatattgcaatccctgtatatcactatagatacacgttaggaagtatagtaaatcgctataggccaaatgcagatatggagcaagaaatttatttggagtatctattttcctttgcaaagagatgtgaaaaaaaggaagactttattaaaaaaatatatatgagagttatgacttcgatgatattactgataaaactcaaatattttaacaaaaataataaagactcttttctgaaaaagagaggggaatgtaataaacttttttgtacgtcgccatataaagatgctttaaataatataacaattaaccagttgggacgaaatgcaaaaataaaatattttttattaaagtttaaattttattatttacttgaaatattgagaagaaaaaattcggaaaatagcataaggtagtttattttctatttgggagattatctgcatgaattcctctatgaagtcaaagtttctatacataaataaacgtagtacaccattcatattggcatatgtagtctttttgtttaattatattttaaatggctatgaatttggtgccacggtagaaagtgtgagattaactgctgcagcactcctcctttttgcatgcgttcaaaaaaggagaaaagatagttttttatatataaatggctttctgcttatttgcattgccattatatcaacactgttttcagatgtggtaaatctaggcgaatcaagagtttttaatcttatattttgtatgattgtgtttattgttctatcagatactttcatagaggtaaatagctttgaaaaaatactatacttttataccaatttcgcttttattttagcggctattgtattgattggatatgtagttggttttggagttgattcatatggaagagcatcgatttattatggatcattctataaagatcaaaactatctttctgcctatttaatgccggcttttacaattaaagtgtaccgttttcttattggtaagagaaaagctttttcagacctgttgtatcctataactataatattagctgttctactaatgggatctcgtggtgcatttgtaacagcattattaatagtatgtctgataatattgaagttgattttgtttgatagtaattctacacataagtttttttggattatgcttgtgtttgtagctgccattgttgtatatgctgttttgtcaaagacacctctttttcaaagaatgactggatttagcgaatatggttcagatgtcagaataaggttatggacggcaggtttaaatggcttttggagacataaatttattggaagcggagtaggagccgcttcacaatttgcatggcagatgattggaaatgcagtacataatagttttatcgagttattatctgataatggattaataggagtcatattggtattctggtcattttctcggatattttgtgcacgaacaaatcacaaggttttaatagtagccttttttactggattatttatgccgctgttttttttgacaggatattcaaatatgacattttggatgccgatgttttttctccagaactttataagctatcttgaacagaaaacgataatgatagaagacaatgagatgagggcagataaatgagaattggaaccatcacggtacaaaatggaaacaattatggcgcatcattgcaggcctttgctttagttaaatatttgagaaaaaatggatgggatgcttatttaattgattatagaaataagaaaatcgaagataggctggcagaacaatcgtttattaccagttggagagggaagaatcaaataaagaaaaatattcggattattttatcgaatgcaatttggaaaacggatagatatgtaaaggaaaaaaacaaagctttttctgaatttcataaatctatatttgatcagtctggcggtacattatatgatgtatcagagttgaaaacacttaatagcttatatgatgcttttatttgcggaagcgatcagatttggaataaagatatcacgggactggatgatgcattttttttgtcctttgccaatcctgataaaaaaagaatcgcttatgctccaagtttaggaaaagaaagtggagctattgttgaggaagattatgatatatatcgtcataagctaagaaatattgattttctatctattagagagccaaataataaaaaatttatcgaaactgttacacatagggaatgctgtgttgtattagatccggtattattattggataaacaggaatgggaagaagaaattcaaaatgtttcgccaataattcaaaaaaggtatgcattatattaccctgtaattaatcagccggaacttgaaaagtatgcaattcaaaaagctagagaaaaggggctaaaattgattaatcctagattagtcccttcatatgcaaagatgaaaggctatacagctatttctagtaaaccagttggaccaattgaattcgtaaaattaataaaagaatctgaatgcatatttacaaattctttccatgctactgttttttcatcaatttttaataaagagttatatgtaattaaactgaaaggaaaaaacaaaaacagaaacaatagaataatcgagtatctaaaaatgataggtattcgtcagtctcttattgacacgagtgatcttattcatataaaagattttgaatcaactatgcaatgggaaaatgtaactgagcggaaaaaagagtcagttgaatacttgaaaaaatcattggattacaattcataataacctgattatgataccggaaggaaggggctatgcctgagattatttcaattatagataacaaacaatgttatggatgtgaggcctgctataatacatgtcaattcaatgcaattacaatgaagaaagtagaagatgggtttagatatcctgtggtagacaaagacaagtgtattgaatgtggatgttgttcaaaaaactgtcctgctatacctggtaatatgagtgtaataaaagataataaatataaacagagagtctattcagtgagattaaaggatacaggcgtaagaaaaattagttcttcgggcggtgcgtttaccgcaatatcggacaaagtattagagcaacatggttgtgttgttggtgttgtatggaataatgatttctctgtaaaacacataattgctaccgaattatatcaaagagatatgatgagacaatcaaaatacatacaaagtgagattggtagttgctataaattaattaaagaaaaaataaaaaatgaacaattagttctatttaccggtacaccatgtcaaaatgcgggactcaagctatatttaggtaatatggatttatcaaagcttatattgtgtgatgtattgtgcggtggcaatgtaagtccagtattttttaaagattatttaaaatatatagaaaaaaaacaaaaagataaagttacagatatatgttttagaacaaaaataataggctggaaacaacatcatattcttattaatctagaaaaaactatatatcagggagctaggcgcgataatgaacccttcttttacttatatttaaaaaaatatattattagaaaatcttgcttttcttgcagctttgcatcgatagatcgaattaccgatattacattaggcgatttttggggaatagatcaagtagaaccagaaatagatgatgatctgggaatttcttttgtatcagtgaatacacagaaaggccaagacttcattagctcagtgacagataaaataatgatggaagagagagaaataaatttagctattcctcggcaaataaacttaagaaaggcagcagagaagccagaaaaatatgagcttttctgggaggaatataaaaaatttggctcagaatatattttgaaaaaatacacaacattcggcatgaaaaataaaattagatgtttgatgaaaaaaatctttaaaaaatatttgaatcataaagaatagagggaggttctggaaaaatgcagagagaaaaagcacttgcaaaaaatactgctattttaatgtttggaaaaatatgtactcaatgtattagttttctgcttcttcctttatacacaagtgttttagatactgctgaatatggtacttttgatataatgattacctactcaatgttagttctcccaatagttaatctacagtttgatcagggccttttcaggtttatgttagaacatcgaggaaaaaataacaaaataacaaatattttttcttcgatatttttgtcttgtattatacaaactgcagcatacaatgtgctcttaataattttaaattttattcatccggtagaaaatatccagttcttaatgatttatgtttcacttcaggtttttgtatctattatgcttcaattttcacgtgggctaggaaaaagtacttgttatgccattgcaagttttatttcagcagtttcgaccgttgtatttaatgtcattgcgcttgtttttttgaacaaaggagtatatggattatttgcagcatctattttagggcaagttgttacaattatttatctctctttcaacaataagatatggaagtatgtgagcattcatgagtttaaattctcaacaataaaagaagtaagccagtattcactgccactcataccgaataatttggcatggtgggtggttaatgtatcggatagattggtaattaaatactttttgggaatagcgtcaaatggaatatttactgtggccagtaaatttccaaatgtttttataaatttttataatattgtaaatttatcctggacagaaagcgtttcgctgcattttactgatgaggatagagatgtctttctcagtgagatgatgacagtcttttttaaactgttttctacatgttgttttctaataatatctttaatgccatttgtatttccggttctggttaactggaagtacaaggaatcttataaccaaatttacattctaatgatggcgatgctctttagagttatggtagggctctatagttgtgtatatattgctgaaaagaaatcaaaaaaagttgcaacaacatcaataacagcagctgttataaatctaacattagatattttgcttatgagaaagatagggttatatgctgcatcggtgtctagcttaattgcttttatgagtatgtttgtaattcgatattttgatattaatagatccattcgaatgaaaatagaatcaaagacattattccttgcgcttactttaggtgttcttttaggtattatatattactctgaaaacatagctattcaatttattggatttataatagtttgtatatattcaattttgacgaataaggatttgataaaaattatattggaatacatagtaaagtttttccgacaaattaaaagaaaaagcaattgacctgttcacttgttggactaaatattaattaacattattttgtttttttgaagaattggagggtatatgaataaatcaatcgagttttttaatgctattgattgtgtttataaccagcaaattcctgaaaatgtgatagaacgagcgagacaatcattacttgattatcttgctgtaacctgtgcgggtgtaaagtttcaggattataaaataaaagaatattttaaatttgcagaaccagagaatggaaattataaagcaataggaacaggtaaaaacgtagtttttaaagaagcagtttttctcaatggattgaatggtcatgcccttgattttgatgacgggactaattcaggaataattcatttaggcagtcctgttttttcgttattaataccattggcagagaaacataaaataagtattggcgacatgctgaaagctgcaattataggatatgaaacatcttacacgatggctgtttcgattcagcctgggcataaagctaagggataccatgcgactggaacgtgcggaaccttaggtgctgcaattgccgcttcttatatgctggggtttaacaaagaggagcgttttcatgcttttgcatctgcagccgttgcagcctctggtatgttgaaggtactggatgatggctctgaactgaaaccctataatgttgcgaaaactgcgctccttgcgcttacgagtatccaaatagcgaaagcaggatttaaaggacatgttgatccactaggaggccgcggtttttttaagatgatgacagaccgggatgatattgaattgaaaccagtacttttaaatgggacatatgccattatgaaaagctatacaaaaccatatgcatcgtgccgttatactcatcctgcagtagaagctgcaattcatctgcggaatcagtacggtctgaaagccagtgatattaaacagattgatatcaaaacatataaccttgcggtagatggccatgatcacatagaaataccaggctcgtacagtgcaaaaatgagcattccgtatgctgtggcggccggggtgatttatggaagagccggactccaggaatttagtgaggatatggtgaaaaacgaagagattcttgaattaacaaggaaagtccatgtgatatcagatgagcaattaagcaaagaatttcctgagattcagcctgcgatcgctagtattatgacaaaatccggaatggtttcagaacgagttgattttccaaagggagagcctgaaaatccattaacaaatgaagagtttaaaaaccgttatgatatgctaatggaatatgctggtgtatatactgatgccagtgattctatatttgatacagtataccgtgaatcagcattagttcatgatgttatgaagtatttatagagaggtctgttatgaaaaatgtaaatattgtacttggaaccatgacttttggagaatcggtgtttgctccagaggttgagggatttataaacacattttttgacttgggctacgacgaattcgatacagcttttgtatataacgaaggtaattgtgaacgattgcttggtgatgttctgcctaaattggataaaatatttcgaattgcctcaaagataaaccccagaattagtggaaaactggatggagaagctgcatataagcaggtaaatgaatcacttgaaagactgggcttagactgtgtggatatagaatatctgcattttccagatcctgcaactccagtggaatctgtgctggaagcattgtcaattctttatgaccagggaaagtttaaggaacttgggttaagtaatttcccggcatggatggtagctgatgtgtggaataaatgtgataaatatggctgggtaaagcctactgtttttcagggagtctataatcctcttaccagaaaggctgagattgaactcaatgcatgccttaaccattatggaatgcgtttttatgcctataatcctatggcaggcggtctgttaaccggaagatatgggcagtttgaagaagaaccaactgatggacgatttacgcatagacccaattatcagggacgttattggaaaaagaatttttttgaagctgtcgatgtaattaaatctgcatcagagagatatggtatcacaactattgaagctacctaccgttggcttgcatatcattctatgttaaatggagaacggggggatgcgattctgatcggagcttcaaagttggaacatatgaagcagaatatatccagcataaaagaaggacccttaccagcagatattgttgatgcgtttgaaacggcatgggaaatcagcagggtagacagtccggaatattttaccctttataaaggtaaaaaatagggaggttaagagaaatgttagatcaggaaagaatatttgaaaaattatgtaactgtggtgtgacgttttttacaggggtaccggattcctatttaaatggtttttgcaactacgcattaaaacactttccagaaaagaatattattgcggctaatgaaggaaatgcaattggtattgcagcaggtcattattttgcaacaaaggaacttcctctggtatacatgcagaacagcggaatgggtaatatgatcaatccactggtatctttggttgatgagcatgtctatagtgttcctatgttgcttctgattggctggcgcggccagccgggaatgggggactggccacagcatgaattgcagggcgagattacaatccctcttttggatgccatgcacatcaactactctattcttacagatgatatcggtcaatatgagaggattacagacgaagctgttaattattgtatcaaatatagaaagccgtatgcactgattgccccaaaaggggttatggcagaagaaaagctgaataataaagatgacttatatcctatgagccgtgaagaagcaattgagattattcttaaccacatgccctccaatgcaatcttttctgtaacaactgggcgagcaaccagagagttattctttctgcgtgaaagaagaaatgaaagcaaggaaaacgatttcctgaatgtcggttctatggggcatgcttcttctgtagcattaggaatagcattggaaaaaccggagagaaaggtagtggtattggatggcgattctgctgctatgatgcatatgggtgccatgactatggttagtaagctgcatgtgccgaattatttacatattattctgaacaatggcgcacatgaatcggtaggaggccagccatctgctggttataaaattgactttacaaagatcgcggaggcctgcggatatgaaacggtgcatcatcctgtgacgggaaaagaggaactgatcgctgcactcgctgcgttgaaagactgtggaaaagcttcttttattgatgtgcgtattcataaagggctgagtggaaaactgcctccgctggatttttcccatagagaagccattgatgccatgatagaagaattgaatagataatgtgtgagttatcttgagtgaaaggatggatagacgatgaacagtatggacaaaacaagagaatttctaaaaacaattggtctgccaggaggggacgcttatgaccttcctgaatcaaaaaaacgatttaaagacaatgggcagtatcgatttgaggttccgggaattcagggaccaaaagtgatgagggcacttctggaggcaatggattcctatggactctatcttcacagagtaacacaaacacaggggattatgcgccttacggatgaagaaatcgagaggatggtagagcttgcacataaatgggagacagatctgatccttgccatagggccaagagcaacgacagatacatctgcttcggtccataccgaagaaggagtccgtatggggtaccgtcttagagggcaggagcagatcgtaagagcagtagaagatgtaaaacgggctgctggaatcggctgcaggggattcctcgtttacgatgaaggctgcctgtgggtgctggatcagatgagaaaggcaggggagatccccgcggactgtcattttaaggtatcggctcatgccggccatggtaacccggcatcggcgaaggtgctggagaacattggtgctgattccatcaatccagttcgtgatatacagctccaaatgttggcggcaatgcgccaggcagtggactgcccgattgacattcatactgaaaatccgaagtccacgggtgggtttatccgtcactatgaggtgccggatatgatacggatcgcagcaccgctctatttaaaaacagggggctctgttgcggctacacacagctgggatagtacggaggatgacgctagaaagagggcaaagcagtgcgtgcttgtgaaacgtatgatcgacgagtattatccggaggctgtgtggtcaccgaaggggagcttaatatagaaaagtaaagcgatgataaaatacatagaaggaaaggataaaaaagatgagacaccatctatataacaaagatttcaaatttttagtagaaccggaggaattcaataaatataccgatagggagctgctgcagtattgccttggtgctacgatgtatatgcctggtatcaaggattttgcgccgaagatccttggaggtgctatgcctggacttacgaccattgttttgtgctttgaggatgcttgtccggaagatcgggtggaggaagcagagcagaatgtataccggcttttggatacggtaacggatgctgtggataaggggaatctggcgccggaagcggttccgcttatttttgtgcgcatacgtaatctcacacaatttaaacattttggacagggcctgaccaaaaaacaagcgcgatcgctgtgcggcattaatttccctaagtttaatgcagaaaatgggtacgaatattttgcttatttgcaggatctaaacgaccgccttgaggagattttgtatggcatgccaattattgaggactcggaagtagcctacaaggagacacgtatatcggaattggtaggtatcaagaagattcttgacaaatatcgcgaactggtcttacaggtacgggttggcggtacagatttctcctcagtatttggcgtgcgcaggggtgtcgattattccatttacgacattatgaccgtccgcgaatgcctgacagatattatcaatgtctgtggacgggataacgattatgtgatttccggacctgtatgggagtatttccgtgcgccgaaggaattaatgtttgaagagcttccgaaacatggactggaagattatctgatgaagcggctgccaattgtgaacaatgagatagatggtctgcttcgcgaagtgattctggacaaagccaacggctttgtagggcgtaccgtgattcatccgacgcatgtcaaatttgtcaatgcgctgatggcagttacgaaggaagagtatgatgatgcgtgtatgatcctcggccatagtgaaggcggtgtggtaaaaggcagtggtgcgaataaaatgaacgagatcaagccgcatacgaattgggcggtgaagatctataatcgcgcgcgtgcttttggcgtgattgaaaacgaaggcgcatatgtgaggctgtttgcagtcaatgactaaagggactaggcaggaaccaacactgtggaaaagaattggaggacactatgtcgattgagataagcacaccgatttctgaagtggcggcagcaagtctgcaggttggggataccgtgctgattacaggatatattctttgtggacgggatgctgtgctgccgaaggtggttaagctgattgaagaaaacaagtctcatacactcgggtatgatttaaaaggaagtgttatttttcatacagcagtgagcccggcgggagtaggtcctacatcgagtaataaactggaaatcgagagcagtatagagccactgtcaaaggctggtgtgaagctgcatcttggaaagggccagattcataaagaaacgataaaggccttggatataaacaatgcggtgtatgcggtaatccccccagtgacggcgctgttaggggataagacgacagaacagacattgattgcttttccggaattggggatggaggccttgtatcggcttaaggtgaatcggtatcctgctattattgcagcagcgcatgggaggagtatctatgagtgaatttagttatgaaaagacagtttctcttgtccggaacacgctggtagaggcagggtcaacgtttcgggaggataagaaagaagcttatcgaaaagcgatagctaatgaaaccaatgagaaggcaaagtgggttcttgagactatattggagaatgccaatgcagcagaaaagaatcatagccctctttgcgacgatactggaatcccgcatatggtgcttgaagtagggccagatgcggcagtaagtggacggatgctggatgctatcaaggaaggtatagcagaaggactacaaaaactgccaggacgtcctatggcgattatgggagatgacagtcagagaatcgaccaatctggtggtttaaatccagaaagtgcaggtgtggagccggctccgatacttatcaggcgatgtagagataatgttgtaaggcttcatatactgatgtttggtggtggtcctgcgatcagaggaaaaacgtatcgtgtatttcataagcacagcacagatgtggtgctgaatgaaatcgtaaagtgggcgattgagggagtctctcaattgggctgttctccatgtactcttgcagttggcattggcagaagccattttgaagcaacatccatgatgcttcaggcgcaggtggatggaaaattcgatgttcagtcggaaatggagcaggagattaccagaagggtgaatgaggctgatatcggtccgcttggactccatggaaagaccagtgtaatcgctacatttatgaaggttggtcctcagagagccagtggtgtaaggattatctgtgtccgtccggcttgttgttttgaaccaagaatcgccaccgtagatttgcagatgatgatggcggaagggctggattcgaagggaatagtaaaggacagattataaatgaagaatctaaatgatagtaagcagaattcaaaagcaagggattgacaatcagcacagaaaagtgatatatttatcctataaagagataaatatatcaccataaggaggctgtcatgaataataaatactccgcaggtcaaaaacccacatttaccagaaaaatcagtccgaagatggggctgttaggttttttggggttgtcgggatttctgggttttctgccccagttttttcgtgaagacggtattttgcctgtgccgtttccgctgatatttttctgcttttttggatttttcggtttttactatgaggggaagatgtccggtacgatgattgatgagcgttatttagccaatgagaacagagccagtgccatagcgaacaaagtggcccttactctgattatcgctgtggcgcttctctcaatgtcggcatttcggatcaataatccctatgtgatgctaaaacttttaattgctgttatcggttttgcatttggcttatcgctgtttcttcaacagtacctgctgtaccgttttgaaaatggagagtagccatgggggaatttacgtgcaatcttaagaggtacagacaaatgaaggagatgacccaggaacaactggctgaaaaagtcggtgtaagacgggaaactatcatgcgcctggaagcgggcagatacaatccatcgctgaagctggcgatcgatatttcgagagaggtggaaacaccaatcgaagttttatttatttttgaggaaaaatagccatatatgcagtagaactgtgatggtatggcagaagattccttgtggattatcaagattgttacactataacaaaaatgcgtcacagttactgccaaacagtaaaatcatgaacacctgtcaaacgggtgctcatgattttgcgcattaagcgttcaaccggctaaagtcataagaagagcagactgtacatcagcctgcccacatgtaaagggaaccatttccaccatccttgatctgggaaaatggtgcttcaatccctcatcttcaatttctcaagtcattaattccataatcctgaaacacttcgcgccccgatctcttgcaggccacctggcatgaccgttatcccgcctttttctgctccttccagtccccggaataaaaataattaatttccgccccaagaaacagtatacagatacacacatacagccacagcatcagcaacacaatagccgtaaggctcccgtacataacagagaaattgctgaaattgttaaaataaatggaaaatgcaaatgaaaatgcgatccatcccagtgtggagaaaatagcgccgggcagctgctttttaaaatgctgcttcttttccggcacatacgtatagaggaaagtgaagcagatcgtgaggatcagcaggagcacggtccgaaagctgatgacgtagtgggtgatctctgcaacgaccggaaaatggtgttcgacgaatccctgaatcgaacttccgagaaccagcaaaaccagcgtcagaatgcagatcagcatgaatatgatggtataaccggcgcagatcatcctcgtcaccacgtaatttcgcttcttctgtttcccgaatacccggttcagtccgcgctcgatgctcagcatgccgcgggaggccgaccagatggcggcgattgccgttacggataaaacggtagcgggagagttggtatagatattttcgacgacgccgaagaccaggctctttaggttggccggtaccagacttgtaattacctgcagcaggttggactttgttatcgttggtatcaactggatcatagccatcagcagcatgatgaacggaaatgccgcgatgatggtaaaaaaagacgcctgagccgcgtaaacagtcatttcatccttgctgaatttgtcgtagatctgtttgcctcgcagtattaatccaatcatgatatcccctttttgttaatgatataactaaaatattaccatgaccgcaaaaaaatatcaagcgagacaccggaatttcaaatcaggttatcggcaaaagcattttaacagttcgaattattttgaaaaacaaactatttttcgaaaataagttgccctaccgtactgcatttgatagaatggtactaatggaatcaatcagaaagggagcgcgtatggaatatataccggcgaaaaccatcgtgacgaagacgaagagctccgaatggttcggcatcgattataatatgaatatttataaaggctgctgccatggctgtatctactgcgacagccggtcttcctgctatcggatcgaacggtttgacacggtgcgggccaaggaagacgcccttcggattgtccgggatgatctgcggcggaaggtgaaaaccggagtggtaggcaccggagccatgagtgatccctataatccatttgaaaaggagctggagctgaccagacatgcgctggagctggtggacgccttcggcttcggagcagggattgccacgaaaagcattcttttaaaaagggatgcggatattttagagagcataaaagagcattcgcctgtaatcttaaaagtgacggtgacgactgcggatgatgaactggcggagaagatcgaacccggcgtgccgtcctcgaccgagcggtttgaactgatcgattacttaagctccagagggctgtttaccggtattctgctgatgccggtccttccatttctggaagacagtccggaaaatattacgactgtcgtgagaaaggcccatgaggcgggagcttcttttatttatgcggcttttggtgtgacgctacgtgataatcagagggagtggtactatgataagctggggcagctgtttccggagcgggatctggcagcggaatacagaaaacggtacggagaacgctacgaatgccggagtccggcggcaaagcggctctgggccatattcgcggcagagtgtgagaaatacgggattctgtaccgcatgaaggacattattcacgggtataagaagaattacgaaaacagccagataagtctgtttgattttctgcagtgaaaacagagaaagtgagaggaaaccttacatgggacaggagaaaaaagaaaagcttacaaaaatggagatagactggattctgtacgatgtaggaaattccgcattcgtgctgcttgcgacgacgattttgcccatttactttaattatctggcgggactggagggcgtctccgaggtggattatctggcctattggggatatgcagcctcgattgctacgctgctggtggcctttatcggaccggtctgcggcgccattgccgatacgaaggggtataagaaaccgatatttatgatctgtatgatggtgggcgttctgggatgtgccgcacttgccataccaaaatcctggattgtatttttggtggtatttgtgattgcaaaggtgggctactctgcgagtctggtgttctacgattccatgcttccggatatcacgacgccggaacgtctggatgcggtgtcctctcatgggtttgcatgggggtatatcggaagctgtgttccgtttgtgttcagccttgtgtttgttctgttctatgaaaagatcggcatcactatggtgactgccatggtgattgcgctcatcatcaacgccctatggtggttcctggtgacggtgcccctgctccgccactacaaacaggttcactatacgggcaacgcggagtcgggacgcggagtggtgaaggagagcctgcgccgcctggggcatacgcttcttgatttgaagaatcataagaagatctttgttttcatgattgcatacttcttctatattgacggggtctataccattatcgagatggctacggcttatggaagctctttggggctcaattcccagggacttttgctggcgcttcttttaactcagatcgtagcgttcccatttgcgctgttgttcggcaaagcggcgaagaagtacaggacggaaaaactcatccgcctgtgtattcttgcatacctttgtattgcgctttatgcgattcagctggataagcagtatgagttctgggtgctggctgtttgcgtcggcatgttccagggggcgatccaggcgctgtcacggtcgtattttgccagaatcattccgcctgagaaatcgggagaatttttcggtatttttgatatctgcggaaagggcgcttctttcatgggaacggctctgatgggattattcgctcagattacgggaaagagcaacggcggtgttgcgattctggccgtgatgtttctcatcggattctttgtgtttgggaaggctgtgaagctgaatgagaattagagtgtgtttcaaaataagttacaaattctttggctatgtttgaaacatagccattttttttgtatatggcggtcatgcgggtgacggtttccggagaatcgataatccggactgtcaggccttcggccggcctcatgctgctgatggattccggcaccagggctacgcctaagccggcgccagcccattggagacacgtcctggcgtcgtcattgcggcagaagatattaggtgctgcgccgatattctggaacgccatggatatgatagcgtcaaagcgccgataatagatgagaggctttccggccaggtctgtaagacggattgtgccgcctgggatcgcgtcaaaccaggaggaaactccgactgccgtaagcggttcttctgatccgaagacacagtgaaaaccgtcggtattaaacggtgttcgaaccacagcgcattcgatgatgccgtttttcagcttttccagaagctcgtaagtgttcccctcggagatttcaaaacgaacattgggatgaagccggcagaagcccggcaggatgctgtccgccagaaagctgccggaggaggagatcgttcccagctttaagattcccttcgatgaggaggggaaattctggagctcatcagcggccgtatccatcatggacagaatatccttagcccgggaatagagataggaaccggcctcggtaagctcggccttccttgccccgcgggtcagaagacggacgcctaagtcctcctccagcatcatgatctgcttgctgagcggcggctgagacagccccagcttttttgctgccgccgtaaaactgcccgtttccgcaatcactgtaaaataatagagctgccttgaattcatctgtcccatggaatacacctctttaataattatttttctgcaatagatacttgtaatattataccagaatgctataatattacaatgaattattctaaaaacatatgaatccggaggaaggataaatgaaaaaactcctgaaatacttaaaggaataccggctggaaagcttcttagggccgctatttaagcttctggaggccagttttgagctgatggtgcctctcgtgatggcgaaagtaatcgatgtcggaattaagacacaggacctcccctatatcttaaaaatgggcggaattctggtgcttcttggagttgtggggctggtctgttccatcacggcccagtattttgcggcaaaggcggccgcgggattcggtacggcgctgcgaaatgacctgttctcccacatcggcagcctctcctatgcggagctggataaggcggggacagccacgttaatcacccgtatgacgagtgacgcaaaccaggtacagtcaggggttaatttatttttacgcctctttttgaggtctcctttcattgtgttcggggccatggccatggcctttaccatcgatgtgaaggcggctctgatttttgtcgttgtcataccggtgctgtccgtggttgtatttggcatcatgttaatcagcatgcctctctataaaaaggtacagcggcagctggaccgcgtgctcctgaccgccagggaaaatctaagcggcgtccgcgtgatccgggcatttaaccgacaggaggatgaaggccgccggtttgatgaggaaaacggtgagctggtgaaaatccaggtgtttgtcgggaagatttcctcccttttaaatccgcttacctatgtgattatcaacctgggcattattgtgctgatacagaccggagcgaaggaagtgaaccgcgggattatcactcagggcgaggtggtggctctggtgaactacatgtcccagattctggtggaactggtgaagctggccaatctaatcatcaccatttccaaagcgctggcctgcgcgaaccggatcagcgctgtgttcgagcagaagccggggattacggagaagaaccatacgtgtctggaagccggcgagggcgctccggcggtagaatttaaagatatgacatttacctatgacggagcgagggaaccggccttaagcaacatctcattttccgtgacgagagggcagaccgtggggatcatcggcggtacaggatcgggtaaatcgacgcttgtcaatctgattccccgtttctatgatgcgacggagggcggggtatcggtggacggccacgatgtcagggagtatccgctggatcagctgcgcggcaagacggggatcgttccgcagaaggcggtgttattccacgggacactgcgggagaacatgcagtggggaaagaaaaacgccacagacgacgagatctatgaagcgcttaagacggctcaggcccttgaattcgtggaagaaaaggacgagggactggagctctatatccaggccggcggcaagaacctgtccggcgggcagagacagcgcctcacgattgccagggcgctggtcagaaaaccggagatcctgatcatggatgacagtgcatctgccctggattttgccacggatgctaggcttcggaaggccattaaggagaggacgcaggatatgactgtcttcattgtatcccagcgcgcaaccacgatccggaacgcggatcagattgtcgtcttggatgacggcgccatggtggggtgcggaaaccataaggagctgtttgaaaactgtgagatttaccgggaaatctgtctgtcccagctttcgaaggaggaggtgcagtaggatgaatatgaaaaagcataaaacgaccatacggcggattctctccagcatcggccggtataaatggggcgtcctggcttcactggcctgtgcattgatcacggtggtcctgactctctatgtgccgattttgaccggtaaagccattgactgcattcttgcaccgggaagtgtggattttgccgttatgggcggaattctcatgaaaattggcgtcattatcctgattaccgcggtgtcacagtggcttatgagccatatcaacaatatcatcacgtaccgtgtggtgaaggatatccgggtccgggcgtttgcaaaggtggaaagcctgccgctcaaatacatcgattcccattcccacggcgatatcatcagccgcctgattgccgatatcgaccagttttccgatggacttttgatgggatttacgcagctgtttacaggtatccttacgattttaggaaccctcattttcatgtttacaatcaatccggccatagcggttgtcgttattttggttaccccggtctctctgtttgtggcaagctttattgcaaagcggacttacaccatgttccggaaacaatcgcagacgaggggcgaactcacctcccttgtggaagaaatgctaggcagccagaaggtggttttagcatttggctatgagtcggaggctcagtcccagttcgaggaaatcaacgagcgcctgcgggtgtggggacttaaggctacatttttttcttccattaccaatccggctacccggttcgtcaacagcctggtgtacgccagcgtgggaattgcaggggcgtttgcggctatttccggctatttgtcggtggggcagctctccagctttttaagctatgcaaaccagtatacgaagccgtttaatgagatttccggcgtggtgacggagcttcagaacgcattggcctcggcggcccgcgtctttgaactgatcgatgaggaaccacagattccggatgcgccggatgcagccgtcctgacggaggtaaagggggaagtgtctctgagtgaagtgaatttctcttatgatcccgaaataccgctgatcgagaatatgaatctggaagtaaaaccggggcagcgtgtcgccatcgtggggccgaccggatgcggaaagagtacggtcatcaacctgctcatgcgtttctacgatgtggattctggttcgattcaagtggatggaaccgatgtgcgggagattacgagaaaaagcttaagaacgagttacggcatggtcctccaggaaacatggttgaaatccggcacgattcgtgataatatcgcatatggaaggccggaagcgaccgacgaggaagtggtcaaagcggcgaaggaggctcatgcccacagctttatcaaacgaatgaaggatgggtacgacacggttatctctgaggacggaagcaatttgtcccagggacagaagcagctcctgtgcattgcgcgcgtgatgctgtgtctgccgcccatgctgattcttgacgaggccacgtcttccattgatacgagaactgagatacggattcagaaggcgttttccaagatgatggaaggcaggaccagctttatcgtggcccaccgtctctccaccatacgggaagcagacatgattctggtcatgcgggacggccatatcatcgagcaggggactcatgagagcctgcttgagaagaacggtttctatgcggaactgtacaacagccagttcgctgtgtgaccggatataacaggacaggtgatgagacaaatgagaaaaacaggacattacgccgcttttatcggacttttcatggcggccgcgcttacggtgaccgcctgcggtgcttcagcgaaagcaccggatgtgagcagcgtcggcggcggatcagagacggctgctgacagcgccgtcggtggaacagaggcagctgcgtcagaggcggatcatgcaggaaagaacggtgcgggaacagatacggcagaagcgtcgggcggtgccgcgggatttcaaaagatcgacacggcagataaggggaactccggggatacagctgctgcgggcagcggggccgggcaggcacagcccattacaggtgcggtgccggcagacggagaggtgctttccggtataccgatcgatacggagaagtcggaagcggtttccatttactatggctctgtgtgttattcgttcttcagcgaggaaaaagacaggattaaagcggtggccgacttatttacaggcttctccttagaggaggtcccgaacggacagctggacgaggcaaccacgtaccagatatatttttcgacggatacagaacagattgcggccataaacgtggataagagcgggatgttctatattccggaggagaagaagttctataaggtgaaggcgggaaccttccgctttgatacgctggatgagatttataaggacagtatgtatgcggatgggtttgatgagaatcagtgtttgattcaatagaaggagcggtgtatggaataaaattcaggcgaaaaatccgcaaaccacttgacatttcctgctacaatggataaaatgaattcagttttatcagataaatgcaatgaaggtgtcagtagaaccttattttctatcagagagagggagtcaccggctgtaagcccccttaagttcagataagcgtttgaatttcccactgaagcagcatggcagaaaccgtcctatgaagacggcgggtaggtcatgacgttcatacacgttacgtatgccgagtgcctgcgcgttctgtgcgggaatcagggtggtaccgcgaacttcagcttcgtccctaaccaggggcggagctttttttgtaataggaaggtgttcctattacaaaaaagccctccgggcaggaggcacactccgcgctgaggaagtatggttgctgaagcaaccgcgctccggcgcgagagtccggcgagccggactctttattcaataggaaggtgttcctattacaaaaaagccctccgggcaggaggcgcactccgcgctgaggaagtatggccgctaaagcgaccgcgctccggcgcgagagtccggcgagccggactctttattcaataggaaggtgttcctattacaaaaaagccctccgggcaggaggcacactccgcgctgaggaagtatggccgctaaagcgaccgcgctccggcgcgagagtccggcttaacgaactctatgtataagaaaaatgataaaagaaggagagcatgatgaaagaccaattagaaaaaatcaaggaagatgcattgaagcagatcgaagcgtcggacgcgctggaaaagctgaatgagatcagggtcgcttatttagggaaaaagggcgaactgaccagcgtgctgaagagcatgaaggacgttccgccggaggagagaccgaaggtaggccagatggtcaacgacgcccgctccatcatcgaaaacaggctggaggaggccaaggcgtctctggcaaagaaggcgagagaagagcagataagaagagagaccatcgacgtgacccttcctgcaaagagaaacaatgtaggccacagccatccgaacaccattgcgctggaagaagtggagcgcatcttcgtcggcatgggctacgaagtggtggaaggcccggaagtggagtatgatttatataatttcgaaaaactgaacattccgaagaaccatccggccagagacgagcaggataccttctatattaacgaatccatcgttttgagaagccagacatctccggtacaggtccgcaccatggagcagggcaagctgccgatccgtatgatcgccccgggacgcgtattccgttccgatgaggtggatgcgacccattccccatccttccatcagattgaaggcctggtgatcgacaagaacatcacgtttgctgatttaaagggaacgctggcagattttgcaaaggaactgttcggaccggagacaaaagtaaaattccgtccccatcatttcccattcacagagcccagcgccgaggtggatgtaacctgctttaaatgcggcggcagcggctgtcggttctgtaagggctccggctggatcgagatcttaggatgcggcatggtgcatcccaacgttctccgcatgagcggcattgacccggacgagtattccggcttcgccttcggtgtcggccttgagcgtatcgcacttttgaagtacgagatcgatgatatgagactgttatatgaaaatgacattcggttcttaagacagttctagggaaaggaagggaaaaaagatgaatacaccattatcatggattaaagcatatgttccggacttagatgtcagcgaccaggaatatacagatgcgatgacattaagcggaacgaaagtagaaggctttgaacgcctcgacaaaaacctggagaagatcgtagtcggcaggatcgaccggatcgaacgccatccggatgcggataaactgatcatctgccaggtgaatatcggcgcggagaccattcagatcgtgaccggcgcaccaaatgttaaggaaggcgataaggttccggtggttttggacggcggaaaggtagcgggaggccatgacggcggccctcttccggagaacggcgtggcgattaaaaagggcaagcttcgcggcattgaatcaaacggcatgctctgctccatcgaggaactgggttcctctaaagaaatgtatccggatgccccggagagcggcatctatatccttcctgcagacgcagaggaaggcgcagatgcaatcgaggtgctgggcctgcgtgacagcgtattcgagtatgaaattacctccaaccgtgtggactgctacagcgtaatcggcattgccagagaggctgctgctacctttgacaagccattccatcctccggtcgttacggctaccggaaacggcgaggacatcaacagctatttaaaagtatccgtggaagacagccatctctgcccgcgttactgtgcgagaatggtgaaaaatatcaggctcgccccgtcaccgtcctggatgcagagacgtctggccgcctgtggcattcgcccgatcaacaatatcgtggatatcaccaactacgtaatggaagaatacggccagcccatgcacgcattcgattatgacctgctggcaggccatgagattattgtcaaatgtgcaaaggacggcgacgtattccagaccctggatggtcaggagagaaagctggacagcacgattctgatgatcaacgacggggaaaaggaagtcggcatcgcaggcatcatgggcggtgaaaactccaagatcaccgatgatgtgaagaccatggtatttgaatccgcatgcttcgacggaactaacatccgtctctccgcaaagaaggtcggactccgtaccgacgcttccggaaaatacgaaaagggtcttgatcccaacaacgccgaggacgcggtaaaccgcgcctgccagctgatcgaggagctgggcgccggtgaggtcgtcggcggcatgatcgacatctatccggaaaagaaaatggaaaagagaattgcatttgagccggagaagatgaaccggcttctgggaacggaggtctccgaagaaaccatgctgggctactttaagaagctggatctgggatatgacgccgacaggcgtgagattatcgttccaaccttccgtcaggatttaaactgcatggccgacatggcagaagaagtggccagatattacggctatgacaagatcccggtaacacttccgtcaggagaggccacgaccggaaaattatcgtataagctgcgtgtggaagaggtggccagagaggttgcggagttctgcggattctcccagggcatgacgtattccttcgagagcccgaaggtatttgacagactgaagcttccggaggacagcccgcttcgtaagacggtgggaatcttaaatccgctgggcgaggatttcagcatcatgagaacctctccgctgcacggtatgttaaactccttatcgacaaactacaaccgcagaaataaaaatgtccgtttatacgaactggcaaatatctatcttccgaagtctcttccgctgacagaactgcctgacgagcggatgcagtttacactcggaatgtacggcgacggtgatttctatgacatgaagggcgtggttgaggaattcttcgacaaagccggtatgcacaagaaaccgcactattctccggaggacaaaaagagcttccttcatccgggcagacaggccgatatcgtctacgacggagttacggtaggctatttaggcgagattcatccggatgtggcggataactataaaatcggtgagagaacgtatgtggctgtgatcgatatgccgtctatgattccgttcaccacattcgaccgcaagtatacaggcatcgcgaagtatccggctgtatccagagatatcagcatggtggtgccgaaggatgtgctggtgggtcagatcgaagacgtgattgagcagcgcggcggaaagcttcttgagagctaccagctgttcgatatctacgagggcgctcagatcctcgcaggctttaagtctgtggcctactccatcaccttccgtgcgaaggatcacacgctggaggacaaggaagtcggcgcggtcatgaataaaatattaaatggtctgcaggcgcttggaattgaactgagagcataaacgatcgtatattcttgcatcaccgggtataaagtgccggagttgtgttcatccttacagaaaatggattgttttgtaaggaggaatacgttatggcggaaggacttgaaattatagaggtgaccgggcgcagaatgctggattcagagggattgccggctgtggaggcggaagtggagctggaaaacggcgcccggggccgcgccatggtagcgctctgcgaggacagcgaagacacggaccgggtcatggaggtactgtcggagtgcgtactgtttgaggacgcgtcagaccagagaggcattgacaagctgctggaggagggcgcttcttcctgcggaatcaggaaatgcggcggtttcttaactgcggtatccatggcggtttccagggcagcggcggccggcctgggaatgcctctttaccggtatctgggcggaacggcgcctggacgcctcccggtccccatgatgacgatgatcagcggcgggagatacggagggaacaactcactcgatctggaatcctatatggtagtccctgtgggcgccgcctcctttggcgaaggcgccgaaaaatgcatggaagtataccaggcattaaaacggcttctcaccatctcgggataccagaccggagtgggagacgacggcggctttgtaccggatttgagaaattcggaggaggcgctggaatttatcatggaggccatgatgctgtgcggctatgagccggggaaagatatgtgtctggccatcggcgcaggcgcggaatcacttttcgatgaaggtaccgggttctatcagtttaagggggaaagccggatgacaggcgtaccggtcgagcgggacagaaatgatatgatcggtttctatattcgtctgctggacggatatccggtctgcgccgtgttcgacgggctggcggaagcggatgcggacggctggggcatgctgaccaagatgctgggaaaccgggctgtatttatcgggcagcacaaaaaccgggaaccgggctgcttaaagccgggggaaagagactgggcctgccttgcagactgggacggcgtggaggaaaacgcagcaggcatttccatgtgcggagcgaagagcgtgacggcggccatggagatggcggatctggccaaaagaaacgggctgaaattagccgtgtcccagggatacggtgagacggaggatccgtacgctgccgactttgccgcggctgtaaacgcagactggatcagggcgggcgcgccgtgccggtcggagcggacatcgaaatacaacgagcttctgagaatcgaagagtggatgaaagtaagaatataaaaatacaaaaaatgcagttgtatttatggaaaaaatatgatatgattaccatgtttgactataggaggtggaaaagggacatgatcagaacgattttatcaatcatatttgttatcatatgtatagcattatctgcaattattttgctgcaggaaggaaagacacagggcttgggttccatcggcggtatggcggatacttactggggaagaaacaaaggccgttccatggaaggtaaactggagaaatttacaagatacggagcgattctgtttttcgttctcgcgttagtattgaatctgaatatactgtaaagattaaacactcttgtggttaggcggcaagggtgtttttgtttcacaggaaaattcatccggtgaagcaagtgccttccggcgcgggagtccggcggccggactatttacgttccttccgggcataatgataaaagcagagggaaccgcagcgtaaaacagaaaacgaggaaattatgacagaggaacaactgacacagagaaagaacatgatattacagctggtggaagaaccggcctacgttccgatgaagctgaaggagatggcgattcttctcgatgtgccgaaggggcagagagaagagctgaaggaagtgctggatgcactgctgtctgagggaaagatcggcatttccaaaaaaggaaagtacggcaagccggatatcggctccataaccggtacgttcagcggccatccgaggggctttggctttgtgaccgtggaaggacgggagcaggacgtctttatacccgaggataagacggctgacgccatgaacggcgataccgtgcagattaccatcgagacagagggcgagggctcaagacgggccgaaggacgtgtcctgcgcgttctggagcacgcgaaccggaccgtgatcggatactaccagaaaaataagaactttggatttgtcattccggacaaccagaagattggtaaggacatattcattcctcagggaaaggatatgggggccgtgaccggtcacaaggtggtagccgtgcttacggacttcggcggaagccagaagaagccggagggcatgatcacggagattttaggccatgtaaacgatccgggaacggacatcatatccatcgtgaaggcgtatggtcttccggaggaattccctgacgaggtgatggatcaggtggaaatggtctccgacgaggtcacggatcgcgagcgggaaggcagactggacctgcgcagcctgcagaccgtcaccatcgacggcgaggatgctaaggacctggatgatgcgatttccgtatcgaaggagaacggtgtgtatacattgggcgtccacattgcggatgtcagccactatgtgacggagaacagcccgttggatgaggaggcgcttaagaggggaaccagcgtttatctggtggaccgggtgattcccatgcttccccataagctgtccaacggaatctgctccttaaatcagggggaggaccgcctggcgctcagctgtatcatggagatcgacgaagcgggcaatgtgaccgggcaccggatcgcagagacgctcatcaacgtggacaggcgtatgacctacacggcggtaaacgcggtcgtgacagaccgtgatgaggcgatgatgaaggaatacgaggagtttgtccccatgttcctccttatgaaggagctggccgatatcctgagggagaagcggaagacgaggggatcgatcgacttcgacttcccggagaccaaggtgattctggacaaaaacggaaaaccgctggagatcaagccgtatgagcggaacgcggcgacgaagattatcgaggatttcatgctcatcgctaatgagactgtggcggaggactatttctggcaggagctcccgttcctgtaccggacccatgataatcccgatccggagaagatgaagagtctggccacctttatcaataacttcggctactccatccggttccataacggagaggtctatccgaaagaggtccagaagcttctggtgaaggcggaggacacaccggaggaggcgctgatcagccgcctggcgctgcgttccatgaagcaggccaagtatacggtggtgaacacgggtcatttcggcctggccgccaagtattatacccactttacctcacccatccggcggtacccggatttacagattcaccggattatcaaggagaacctgcgaggcgggctgaatgagaagagaacggcccactacgataagcttctgaccggcgtatcggtccagacctccgccatggagcggcgggcggatgaggcggagcgcgagaccgtgaagatgaagaaatgcgagtatatggcgggccatatcggcgaggtattcgacggcgtcatatcgggagtcacaaactgggggctctacgtggagcttcccaacacggtggaaggcctgatccgggtaggcgagttaaaggacgactattaccattttgatgaagagcatttagaattgatcggcgatatgacgaggaaggtatataaactcggtcagccgatccgcgtcatggtcacgggaacggataagctggccaggacgatcgactttattcccgcgagcaacgagtcaggtgagcgcgcttgtgggttcatctgacgactgccgcgagggacaaaaaccccgctggcggggttttcgtctcccgcgagcacttctgcggaggaataacaggaggataaaaggatggggaaagagagtttcaagctggttgccaacaacaaaaaggcatatcatgattattttatcgatgagaaatacgagaccggcatcgagctggccggcacggaagtgaagtccatccggatgggcaaatgcagcatcaaggaagcctttgtgagaatcgacaagggggaagtatgggtatacggcatgaacatcaatccatatgaaaagggaaatatcttcaataaagatcccttaagaccgaggaaactgctgatgcaccgggcggagatcagcaagctggattccaagattgcgatcaagggctataccatcgtgcccctccaggtttactttaagggcagcctggtgaagctggagatcggcctggcccgcggtaagaagctctacgacaagagggatgatatcgcgaaaaaggatcagaaacgggaactggaacgtgatttcaagataagaaacctataatatgagacgcagtctgcgtcctgaagagcccacgggagaaaaccgtggcttttgggggcgcggactgcgtcttttgtctttgcaaaacagatgcgaatgcatgcccaaacacggaatgaggtctttcacgaatttattgtttgtggtatactgtaaaagacgaacatacaataagaggaaaactgagaggagaatcggttatggcgctttatgactattcaggtgctttgaaaaaaggaagaaaacagtatcaggtttccgtggcaaagggagagtatccttatcttccggtgctggatgacatactttcctacacagatatcatttcagaagtgaatctgggactcatggacgtcccgctcgataagatcgtgggaacgaaaacaaaaggcagaaccagtgcctttgccaataattttatgcctctgctggcagaaaaatcggagtttggagcaaaatgggcgtatttatacgaccatcagatagaagaagggattcatgaccccatcgttgcgtatgagttcatgaaccagtactatgtacaggagggcaacaagcgtgtcagcgtgctcaaatatgtgggcgcgttcagcattacggcttcggtgacgcgcctgatccccaagagaacggatgacctcgacaaccgcctctattatgaattcctggagttttaccaggtctcctttaactgtgatgtctggttcagccaggagggcagctacgaccgcctgttaaaggccatgggaaaggccccggaagaggtgtggagcgaggacgacaggatctactttaaatccgcctacgaccagttctccaaggcgttccgcgcgtttggtgggaattcctatgagatgacgtgttccgacgccttccttgtctatgtcgagctgttcggctacgatgtggtgaagctgaagacagagggcgagatcacaaaggatttgacgaagattaaggatgaacttctcctgacctccagaggcagcaagatcgccctggtagagcagccggaggaggtggaagagccggataacagcccgttgaagatcatcaactggctccgcccatcccagaacattgagccggagatgctgaagatcgcatttattcacgcgaagaccgcggagacctccagctggacctatggccatgagctggggcgtatgtacctggagcaggcctttgaggggcggttaaagacggtcgcattcttcgaggccgatacggatgcggagattgccaatgccatcgatctggcgatcgcggccagatgcaacatgatctttacgacggcctcccagatgatcggtttaagcgtcaaggcggctatcgagcacccggaggtaaagattttcaactgctccgtcaacatgtcgtactcctctgtctgcacctattatgccagaatgtacgagtcgaaattcttaatgggcgcgctggccgcttccatggcgcagtgcgataagctggggtatatcgcggactatccgatctacggaacgatcgccaatatcaacgcctttgcactcggtgcgcgtatgattaatccctatgtcaaggttcatctggagtgggcgagggtaaaagacaggaatgcccgcgaggaactggagaaggaaggaatcacgttcatctccggggaagacatgattacgccaaagaccgcatcgagagaatacggtttatataaaaaagaagcggacggagaattccggaatctggcgacgccgatctggcactggggcaaattctacgagaaaatcgtaaataccacctgccgcggcggctccgatgtaaaggagatgaagggaaagcaggccatcaactactggtggggaatgtccgccgatgtcatcgacgtcatctgctctcagaatctgccgcacggcaccaaccggctgatcacgttcctgaagaactcgatccggagcggaagcttccagccgtttgtgggaacgatctattcccaggatggaacggttcagtgcgaggaggagcagaggctctctcccgaagagatcatcacgatgaactggctggctgaaaatgtggtgggtaagcttcctgagttcgatgagctcacagaggaagcacagtctctggtaaggctgcagggactgacgatatacgacaatgcggtgatggaggaataatagtttgaagattctggtactggctgatgaggagtcaaaatccctttacgagtacttctcacccgagaagatcaaaggggtggacttaattatatcatgtggggatttgaaggcctcctatctgactttttttgccaccttctcccatgcgccgcttctgtatgtgaaaggcaatcacgacgggcattacgaggagcggccgccggaaggctgtgtctgcatcgaggatgacatcttcgtgttccgcggcgtgcggattctgggcctgggaggttccatggagtatattccgggagccgacaaccagtatacggaaagaaggatggagcggagaatcaaaaagctctggtggaagttaaagaagaacaaagggtttgacattctggtgtctcacgcgcctgcatatcagattaacgatatgcaggatctgccccaccaggggtttgaatgctttaagaatctgatggacaagtatatgccgaagtattttatccacggccatgtccacgccaactacggcggagggttcaaacgcgaggatacatacgggaaaaccagagtagtcaacgcatacgaatattatatctttgattatccggaaaacggagaacaagcggcacaataattccggaaaggggggatatcctatggaggttttttaccggcctgaactttctgttcagacgctgttgatggatgcgaattctgtgcaggaaactgcggagaatctggccgactatatcaatcatctgatgcatgccgattcggtactcttagtccgcctggacaatcagatgcgttataaggaagttggctcctggagaagcggaaaaggcggtgacaccggtgcggaggcggtcatgagacagtggcttccgcggctggttgaaagctggaatacgcgggagaagctttccggtgaggagctggatgcctttttaaaggcgctcacaccttttacggtgccgggaggttatctgacgattctgccaatctgcaataatatacggtttgtgggatttgcggtatttggaaaaaaatccggggagggcgactggacggaccgggagctgcccatactccggtttttgctgtccattatcgcggtgacatttgccaataagaacctgtatgaagactatatgctgcagaactgggtatacaataccatgatgggccgcatgcaggcgaatctgtatgtgaccgatatccatacggaccggattctgttcatgaacaaaacgatgcaggaagcgtttggcctggagaatccggtgggcaaggtatgctggcagattcttcagaagggaagcaggggaagatgccccggctgtccggtacagaggctgacggagtccggggaggaaggcgtttaccggcggtgggaggagtttaacactctgacgggccgctactacgataactacgacagcctgatgaaatggacagacggctccaccgttcattttcagcattctctggatatcacggcttccaaaaagctgtcgaaggaggccagcacggatgatctgaccggccttctcaaccggagaggcgggaagaaccggctggcagagatgctggatgcggcgagacatcaggagacgattctgacggtctgtatgtatgacgtcaattccctgaagaaggtcaatgatacgttcggacaccgggagggggacaatcttctgcgggtcattgccaactcggtgaagggcgttctgaccggggaggacttcgcatgccgcttaagcggagatgaatttctcgtaacgtttgcagggaagacggagcaggaagccgctgcattgatcaaactggtggaagagaggctgctggctgtccgcagacaggaccggattccttatgaactgagcttctgtacgggaattctggagctgaggccggagcacaccatgagtgtgacggatattctgcgggaagtggacgagcgcatgtacgagcagaagcgccagtatcacatgcagcaggggaaggagtcggtgctggcggcagcggaggcccagtggcggcttttaaagccggaggcgtttgactacgaccagcagtacctttatgacgcgctggtggagagtacggacaactatctctacgtgtgcgacatggcgaccaataccttccggtacagcaggaagctggtggaagagttcgcatttccgggtgaggtgattcagaatgcagccgatatctggcgctccatcatccatccggccgactgggaacggttctgggaatcgaaccaggcgatcagcgacgggcggaccgtgagccatgaggtcgaatacagggcgagaaaccggaagggccagtggatcaagcttcactgccgcggtcatgtggctcagaattccgcgggagagccccgggtatttgcgggattcatatcgaatgaaggccagtggttcccggagtggaccgaatagaacgacgggagtaaaaggatggattacagatttaagctgtgtttttgcagggatatctatgatcataaacagaataacagagcttttatggaggcagtccgcaggaatgtggactgccatctcttaaagtgcgaagattacaggcggattctggagagccggggattctcgcgggaggatggaaaacgggtgacggatgcgggggaggtgccgtgcattccgaccctgttttttaagtaccacgatctgcattccatgccgaaatccgccatggtggtaaaggccacctcctcggggacaaagggagtgaagagccatatcggatttgacaaaaagagccttttcttcggtggaatcgccgcatgccgggtcatcgcccgccacgggctgttttccatgcgtcctgcccgttatgtaattctggggtttccgcccggaaaggacaatcagacggcgatcagcaagacccagcggctcagcacgatgtttgccccggcgctcagccggcggtatgcgctgcgaaagggaaagaacggataccggcccgattttaaggggctgatggcagccctccggcgttatagcggaggaagggctccggtgaggattatcggctttccggcatacctctatttcctgttaaaggagatggagcgaagagaaatctttctccgcctgcccaggcattccatgattatggtcggcggcggatggaagcagttttacaaagagacggtggacaaggcggagctataccggctgtgtgagaggcatctcggtgtgccggagagtcatttccgggagtttttcggagcggtggagcatccgggcgtatactgtgactgtccgaaccaccatttccatgttcccgccacgagccgcgtcgtaatccgggatgtggatacgctggaaccagtcggctatggaaaggcgggactggttaatctaatcagtccgctggctgaaagtatccctctggtgagcatactgaccgatgatctgggcgtcctgcaccgcggatgtgaatgcggctgcggaatggaggcgccgtacctggagatcatcggcaggaccggtgtccccgatatccggacctgcgcggccggtgcgggagaactgttaaaggaggtgggacggagtgcattccattgatctggaaaaaaagacagcggccgtactggagaagccccctctctccagaactgtggtaatgagagcctgcggccggttagccggactcttgaccggaggcgcgtatgacggcgagatccgggcgcgcgggctggagaagcttctgacgagagagagaatctgtcaggcggcttctttcctgcgggaggatacgctggagagaagggtgaagacagagcttttgggccttcagaaccgttttctcatgcctctgggcgtcctcatgcacgtgaccgccggcaatatgaccggaatcggagcctacagcgtgctggagggccttctggccggcaacatcaatctcctgaagctctcttccgaagacgacgggctttcggtgttcctgcttcaggagctgatccgtatcgagcccgtgctggcggactatatctatacctttcggattccctccggggatcgggagaggctcttaaagctcttaaggctctccgacggcgtgtgcacgtggggcggcgacgaggccatccggggaatccggagcctggctcccgcggggacgaagctgatcgagtgggggcaccggatcagttttgcctatgtcaccgaagcgggccgcagcaacggggaagtgctgcaggccatcgcggatcacatggtacggaccagccagctgctgtgcagctcctgccagggaatctatgtggaggcaggggggcgggaggccgtggatttcagccgccgtttcttaaggctgctggaacattcttatgaggagtatgggaataaggaagtgggattccggggctgcagcaccatccggatctaccagaaggaactggagtccgccatgacgggggaacgcatcttccggggacgcggcgtcagcgtcaccctgtcggaggagccggggcttcagctgtcgctgatgtacggcagctgctgggtgaagccgatgaacagggagaaactcgtaaagaccctgagaaaggaccgggggcggcttcagaccgcgaggctggtctgcctgggggaagaggaaacggagctggtccggatgctggcaggagcaggggtaaaccggattctgacgggacgggataaggaggcgggagagccgttcggaagccacgacggcgagtatccgctgatccggtattcccggattatcgagacagacgtttcactgtgaatctgccagagcaggacgtttgaggcaaaacgcagaaggaaagccttgtggcctaaatctaaaatatttttaggtaatctaaaatatttttgtgcaatgtgatgatttttcagtcctatgttaagctacaatgtccattgaagtgtgcattttttcgtgttatgataaaataacaaaaaaaattagaagacaaaaataatttttaggagagatgcgcgcatggatcatcacgtgataatgaaaaagtaccggatgtttttgtatggaatgattgtggccgctttaggaatcagcatgatcacaaaggcggagcttgggacgtctccgattacgagcccgtcctatgtcctgacgtttatctttccttacagcctgggagtcttcgtactggcagtaaacagtaccctgtttcttttcgagtgcctcgtactggggcgcagctttaaaaagatacagctgctgcagcttccggctacgctgatcttttccgcctgtatcgacggctggatgtgggtgctgtcattctggactccggtgttctatggacagaaggtccttctgcttctcgccggatgtgcggccctgggactgggggtagcgctggaggtggtgcccgatgtgctgattcttccgggagaaggcctcgtccgcgcggtatcacgcaggaaaaactgggattttggcattgtaaagacatgctttgatatgagccttgtccttgcggccgttctcctttccgttctgtgtctgggacatgtggaagggatcagagaaggcacagtggccgcggccttccttgtaggcggcatttccaaattctttatccgccatatcacggaatttgacaggaatcacagagcactttttgtgcgcgaggaagaggagattctcctggtgccggaaaaatagaggcgggctgaaacggtccttcgtatcccattgcgggagcggagggccgtttttcatttttcggcgaatccccgttataatgtgacacctgtcatattaccgccggtttggcaatggtataatgatcctatcgaatcaatggaacgtttgaaaacaatcggaagctttaagaaaggacaggatcatatggaacagaaccgggtactggatgtgctcacatccaaagaattaacgtatgagcagaaggtattttcactggcgaaggaagcggaagacagcctttccgtactggacattccgccgaagaccaggcagtattttgagacgggtgcgctgaatgatttgtttgaggggcatgcgccctaccctaccgcccaaggtatatcatgccggactataagaaatttgtgaaacaggggagcgaattcctgcgggtagagcctccgaagacgtttgacgagcttctcacgggacttcagatcctctatcaccatgtgccctccatcacgggatttcccgtatatctgggagaactggacactatgatcgagccgtttatcgaggggatggcggacgatgtggtgaaggaaaaattaaggctgtttctgatctttctggacaggacgattacagacagcttctgtcatgccaatctgggatcgagaccgaccagggcggggcggataattctggagctggaaaaggatcttcagaataccgttccgaacctgaccttaaagtacgatccggaggtcactccggatgagtatgcggagctggccgtcgccacctcccttacctgcgccaatccggcgatctgcaacgatgcagacaaccgcagcacctacccctgtgaatacgggatttccagctgctataacattcttccggtgggcggcggcgcctacacgctgtccaggattacactgaccgagctggtcaagagcgcggagtccgtcgaccagttcttacaggagctgcttcccgactgcctggaggcggtgggaaactatatgaatgagcgggtgaagtttctcgtggagcactccggctttttcgagtcgtcgttcctggtgcgggaaggactgattgaacgggaaaaattcgtgggcatgttcggcgtgaccggactggcggaatgtgtcaacgctctgatggccgacacgggagagcggtacggacacagtgaaaaagcagatgaactgggactgcagatcatggagatcattcggaagtttgcggcggatttcccggctgtttattcggagattggccagggccatttccttcttcacgcccaggtcggcttagacagcgacaagggaatcacctccggcgtgcgcattcctgtgggagatgagccggagaacctgctggatcacctgcgtcacagcgccagattccacgaatacttcccgacgggagtgggagatatcttcccctttgccgtcacggccagaaagaatccgggagcgctggtggacattgtgaaggggtccttccagttgggcgtcaaatacatgagcttctatgcgtccgacagcgatttggtccggatcaccggcttccttgtgaagcgcagcgagatggaaaaatacaggaaccacgacgtcgttcttcagaacaccaccgtgcttggcagtaagaattacgacaccaatcacctggagatgcgaaaggagcgtatggcgtgaaagccccggtcaataagatcatcccggtcagtgtggtagacggcccgggtaaccggaccgctgtgtttcttcagggctgcaacatttcctgtgcgtactgtcataacccggaaacgcagaagttatgcacaggatgcggtatctgtgtggacggatgtccggcgggagcactggccctgaatggcaaaacggtgtcatgggatgaaaaaaaatgtgtttcctgcgaccggtgcatagccgtctgcccgaattacgcctctccgaagatccgggagatgagcgcagaggaggtctttgaggaggtatccggaaatctgccgtttatccgcggcattacggtatccggcggagaatgctgcctctatccggaatttttaaaggagctgtttggcctctgcaaagaagccggtttgtcctgcctcatcgacagcaacgggatggtggatttctccctctatccggaactgctggagcttagcgacggcgtgatgctggacgtgaagagctgggatccagaggtttaccggaggctgacgggcgcagacaatgccgttgttaaaaaaaacctggagcttctctggaagaaaaataaactggaggagatccgcatcgtctgtctttccggggaaagcgattacgaggaagtgctgagagggatcgccggtcttatgggaagcccggtcacggcaagagtcaagctgatccggtttcggcccttcggcgtcaggggcaggctgagcggcgcatcggagtctgacgacagggtgatgcaggagctggcggcatgggccggcgagatgggatatcggaatgttgtgcttacatgagtcatggagatacagaaaaaaagggacttttccttgcagtttatgcgtggaaaagtcccctttttttatatactttatgcaaacctgataatttctattttccagattttacctcatataaaaaatatagcatttagcatatacaaaatgcacaaaaataaggacgaaaaagatacaaaatataaaaatagcttaggtgtgacatgtgtcatagcagtaaaattgactggcgtgtatgataaagctacagaaagcaagaaaaaataagcagttcgttgtgatataatgatgcagaccaaaaaggtacagaaaggaagccagaaaatgaagacagaaaaaacatctggtcagctgagagagctttttcgagttgcatacgtagaaaatcaggaccaggcagtgaaaacccatgaactggaccggtttttaaatccatgtatcacgatgcggacggtgaagaagggagaggatattgtccggccgacggataagcttcagtcaattattatggttgtaaagggaggggcccatttcacccgcgtttccacagacggaaacaccaatatgctcgcggcggtcaacgctccgttttttattgggatcacgcagctggtatcaaacgataaggagtactattcccagatcattgctgcaaaaaactgtctgctcctttacattgactgcaactactttttaaaggaaatccgggaggacggagaggcggccctggtggtcattcgggatctcgccaaagtggtggagagaaaccatacgaggatggaccgaatggtatttttaaaagcctccaacaatttaatggcatacattgaaagcaaatggaatgaaggcgagaccagccgaaaggacaggcagctcataatcagggagcgccacggagtgattgccgcggatctcagcgtaagcgtgagaacgctgtaccgttcgatcaacagcttgaaagacgagggacttttatcggtacagaagggcggcgttctgatagtgaatgaagcgcagatggaagagatgaagcgcagacttgtaaaattgggaaaaatgtaattaacatttataatttatataagaggagaaggagaaaagattatgagacattacaaaaggatcgtttcaacattactggcggcaggcatgggactgtcacttctgaccggatgtcagagcggccagccgacaggcggaactgcggcagcagaaaagacggaaacaagcggaaaagcggaagcggcctccgaggacggcgcacaggataagaaatcagatctggtggtcggaatgattgccagcgcgtttggaacacagagctacaacgatgacgtactcgccggaatggaactggccgagaaggagctgggcgtgaagggaattccgctggaggttccggagatatccgactctgcaaacagcctgcgcacactgatcagccagggcgccaacttcatcatggtaccgtcttccgaatataaggatggaatgctggaagtggcggctgagaacccggaggtaaagttcctgtatctggccgaagccattgacggcggcggaaacatcatgtcggttgcttaccgtgaaaatgaagccgcattcttgggcggcgcgctctcaggactgatgacgaagaccaacaacgtcggcgccgttatggccgttggtgagacactgcagtaccgctatcagttcggatttaccgcaggcgtcaaggccgtgaatccggaatgcgaggttcagtccgcatttaccaacagctacaccgatgtgggacagggcagcgaggttgcgaagatcatgtacaacaagggggcggatatcatcggaacgtattccggcgcatgcaacctgggagtcttcaatgcggccaaggatgcaggcgaaggaacgtactgtttaggcgcagccaacggacagtttgacaagatgccggataagattctcgcttccgtagtaaaaccggcagaccaggctattttatccattctgaaggaataccaggagacaggcgtcttcgatacgagcataccgatgtccctgggcctgaaggagggcggcgtaaagctgttatttactaacaatgaagagctgttaaagctgatccccgatgatgtaaaaagtgccatcgacgatctgaccgcaaaggtagagtccggagaaatcaaggttccttccagcgaagaagagtttaacagctttacttaccagtatgcgaaatagccgcgtatcgaaaatcagagaacggaggtgcctgaagtggggagcatcattgaactgaaggggattacgaaacggttcccgggaatcgttgccaatgatcatatatcgatcagctttgaagagggagagatccatacgctcgccggagaaaacggagcgggtgaccgtgttataataagaccaagttagcaaggaacccaatgaaatcaagggtttgcggctactttggtcttaatttattataccacaatcgaactgctttttcattaaaaatccagtgtcgttttccaaagagtgggatattttaaggctaggggtcgcaaccgggtggtttgggacctgcttatacttagtcctattccaaatatccttttcttttgcttcgtccgaagtaaaaactctctttcgggagaacagcgctgttaaaaataaatgaatatagaggactaagtgaagcaactttgttagctgaccttagtcctcttatgcattttaggaggaaaagggtatgcagatactatttattgtgattatttttttgatagtgttgccaatggtcgtaagtatttcgttggctgtgacagcaaagaaatcagacgaaagattacgcaccatctgtacttctcttgaaaagaagggcaggtgagcgtgatgcgagagtatacgacaggaaatcgaatcgtagatgcaagtgccgaaatcagtattaccggcaacattacaccacaagcatggtataagacgattgttaaagagacgggaaaaccgcatttggctgcaatcgttatattatcagatattgtctattggtatcgtcctactgaattgagggacgaaagcactggacagatcattgcaattcgtaaaaaatttaaagctgatttactccagagaagttatcaacagattgcggaacagtttggattgagtaaaaaagaagctactaatgcaatcatctttttggagaaattaggcgtaataaaaagagtattcaggacaataaacttgaatggacttgttgtaaataatgtactgtatattgagttgattgttgagaaattgaaagaattaacgtatccgcactgttatgatgcccctatcccttctatgggagacaggggggaagacattgtagaggaaatcgttgaaggacagtgctttactgtgaataatagtgagatggcagtcattggtgagggagctgtctccccaaaaagagagagggtatcacccaaaaaagagatacctgccacgccgcaaaatagcaggtgccacttttcagaaggtacagcactatctggtaacaggcagacaaatacagatattaacacagatatttcaacgacagattataccaatccagtccagtcctatcaaaaaacgttacaggcatttagagaaaagattggatacgatgcgttatgtattgatcgtccctttgatattgatcgtctggatgaaattgtgggaattgcagttgacgtactgacttcaacgaaggatacgattcgtattaaccaggaagaaaaaccaacagccattgttaaatcggtgttttggaaattagatatgtttagaatacagtttattttaaataacctgtcagagacgaaaacaaaaatcaggaatatgcgtgcagtgttgctaaccgccttatataatgcgacattcacattaagtaattccgttatgaatcaagtggtgatgaatggtgacatctcccctcaatatgcatgagcaaagggggtgatgagcagttactagggttagacaattacgcatagagaagaatttgacacagtgggaattggcggacaagctggatatcagtctccgcacatatcagagaattgaatacgggcaacaaaagccgtcctacaaagtcattttagtcttgcaaaagatatttaacgagaatattgaatctatcctgcaggaattataactgccaaataagaagtggaggaaaatatgtttgatattaacaagctggaggtaatggacatagtatttgccgatgaagcacatgagcgtttcttttatgaaaaggtgcgggaacttccaaattcacgcagggacagtgaagaaattgctatgatatatactcttggtatctgtgacaagacaagggcagctttttcaaatattgtggatcaaagaacttttcaggtgaatccgttggttttattcgctgggtggcagacatctgcttctgtgaaggtaacacggctggcgattaacctctatactggattttcgcaggaagtaaaacgggacgattcaatagaaggatatcatataggggaagacagttcagattatgctgttgaagaaatctttgattgcccatatgcaaaatattttctggaagccgttaaactgcgttatgacatatagaggaggtagaaacgatgaaaatgtataagattgaccaaatcatggagttattacagttaggaaaagaatcagaagattgctatgtgggttttgagaataatgacaagggaaatcttgttattatattaaagcaacatgaaccagattgggaagatgatgagggtttcggagaagcggttgaagaagtcgaacttttggaacattctggagaatattaaacataaggaggagacagtcattatggatagagaaatacttggaatcgaccatggtaacagacagatgaaaacggcgaataccgcatttttgtctacagtaacacagaataaggtgaagcccagtaatctaaatcagattttggagtttaaaggtaagtattactcaatcggtggcagtagggaagatgtggatacaaaagttgataaaacagtggacgatgattactacattctcacattggcatcacttgccgctgaattgaaagccagaggaaagaatcaggcggcggtcaggctggctacaggattaccaccgaggtggtatgaatcgcaaatgaaagcattcaggaaatacttgggcagggaaagggagttatcttttcgttatcagggagaagggttcaatgtctttctggaaggcgtgagcgtatatatgcaggggtttgcagcaatcacagatatattggcagagacacagggaaaatcctgccttctggtagatataggaggaggaaccgttgatggagttccaatagaaaatatgcgacccagtggagcacagcctattatagataataatggtacaataaagtgtatatccaatgtaaatgaggcattaatggctgagtttggggaaaaagccaaaccatatatcattgaaacgataatgcggacaggtacatatgcgggtgacgaagcctatcttcgtgtaatccgaaaggcattgaaccaatatacggaatacatctatagcttgataaaaaagcacggatacaatctgcatttggaaaaaataatctttatgggtggaggagccgcaatcatgcagaattttggtgataacgagggtaaggacgtaatctgtattccggatatacatgcaaatgcaagaggatatgaagaaactttaaagagcatatggaaggccaggcagaatatggccggttaaggaggccataaatggacgataaatatgttacaacgcttcggctttataaaaataacccggtacatttccaggcacttacctgtctggaagagtacaaccgggagctgtttacttctcaaaatgactatattgccgaggcggtaatctattattcagagtatctgaagcagaaggctgaatatgagaaattggaaagtatcctctcaaacataagagagcaagaggaatacttccgtgaactgacaaaacgtgcattggaagacgtactgagatcagtgcagacgactactattcctgcagttactggaagtgacacgaaagcaaaagaggaacaggaaccccaaagtgagagtgaacgatcagcggagacggcgaaccaggcgacagaaaaggattttaatctgcttaatttctatagttcattcactggatttgaagacgaaggagaagattgaatatgaccatattatgtgctatgataaaatttataggaaaattattacttggaattgcgtatgcaatattaaaagttgtatcatttagtgtcaaagtgataggctgtatgtttttatttgtatttcatattttcatgcttttagtagacatgggaaccccttcctaataagtcaaggagagtacaattatggctatttgtaaaatttgtggcggagaaatgctggaacatgtgggttgtaaaatagggatatgcaattgtaatggaaagagttacccgcgtatcatttttggtgcagagaaaaggtttgaggatgtatttggcgaagatgatatctgcccagattgttttgcgccatttgggagttttcaccatttgggctgtgatatagaggaatgtccggtatgtggagaagcaatttatggtgattgcgaatgccagttgattcttcccgatttagcggatatggaagaaatgttaaagtaatagtgaataatgagtatcactgtggtaggctgattcgtcagcctgcttttttttgcgcttttcttggtacttataatgaaaaataaatgaagcggggtagtgtaaagaacatgtctggatgctttaccaggagattgtagggcggtactacactccgcaataaagggaaccatttccaaagattaataagttgaccaaccaattgaaaagaagaggaggaataggaagcgaatataagagtttttacaaaaaagtaagaggtaacgaaggagacaaatgcaaatacagtgtacgactggatacgtatggatgtggctgtcagcacgattgtgattattgttatgcacggtcacttctgtcttttcgtggattttggaacccatcagcgccgagcatcgcagatattgataagattaagaggaagattcggaagatacctccgggaaccatcctgcgcatgggtggaatgacagactgctttcagccttttgaagcggaacatcatgtgacttatgagacaatctgtgaaatgaaccggtgtggtgttggatatctgattgtaacaaaatcccatttgatcgcacagcccgaatatctggaaattttggacaaggatctggcccatatacaaatcacggtcacgactttagatgataacaaggctttgacctatgaaaaagcaagtatcccatcaaaaagagtagaggcaataaaaaaattgcaatctgcgggatatgatgtgtcaatccggttaagccccttgattgaggatttcatggactttgacagcctaaattcattagggatcaatcgctgtgttgtggaatttttgcgtgtcaatagctggatcaagagctggctgcacgatgttgatttcagtgggtacaggttaaaacaaggaggatactgccacttaccactggaaaaaaagatggaaatcatcaagaagatcaggataccggagataacagtttgcgaagatgtaacagaacattatgagtattggagagataacttcaatccaaataaggatgattgctgtaatctgcgattacataacggatgatgaaataaagaagtggaaatgaaagttcctttaaatatatgctgacaggcaggaagggcgtgaagatgaaccggattcgtgacgaacctaaatcgtaagggaaatgacttgagtgggttactgaactttagcagaaaaggggaaaccgttggataaaaaaagttttgagtatggtggatatcatttttatccattaaggacatttgaggataaagatggcgattttatggaacgcgcatgcaaactgcgggatgaccgggaactagggatgacatccactgatgaaccatggagaaaatatgcatatgattatgaagctttttataaagctgccggcggcaagaaatatgatatttttctatgtgaagaaaaccgcaggcagtacgtaccgtgcggtcatggcttgcaggaatttgttaatgccccgatcaagagtaaaaataacagggcagtccgctgagagtatgatggcgcgggtattaagaaaaacacatggaatgggctgatcttcagtccgtttttatttttgaaaatcaattaaattagaaaaccagtaggaggtatgtaaatgaaaacaaagatgagaaactatctgatcgctaaggtaatgaaggtaaaagcggctattaacaacaataaggcggaggggttcgttgatacggccatcttttcttaactacagcaactctatataaatgtatacgatatagatagtggttaatccctttaaccataagggataagtggagggaatgaattaggtggagaagctggttcacttcctgttttatgtacacgatataaaatataaggaaagaggtagaatcctatgaaagagaagatgaattccattaagataaaggcaataaggctgtatgcaaggacgagcggtatcctgacagataaaagaggggaaggctacattgacacggccattgtcatattgatatcggtggtgctgggcgctttactgttggccggattatacgctttattcggagatgttgtgctccctgaattaacaaggcgtattcaggaaatgttcaattatgccggatagaggaagtaaatggcatggattcatggtatagttagcctgtgccagaggcgcaggaaggatgaaccatggaaaaacgatttcgggtaaaacggtttctatttgaaaccacagctggagatgaggtctgccgctatatgctgacagaccggcttctccctatgctggcgccaaaccagtatattgagatgaaaagcatcaataaacttggcacaggaaaaagttacgcctataagctgtgcgtgtattttaactttttgcatgagaggcatcacacaaattatgagacagcaactaacaaacaggttctggagtttgtagatcatttgatttacggagataaggaagatctaagaatattgagtccgcaagaaagtctctgttatagcacgctatccggctatgtaaccgccataacagacttttaccgctggcttgaccagacctacggcagtgagatggcgttttacgaaggagagcgcagatgccggccacagtcctatctgtatggacagatatacacttaccagtataaatacctgattaaccgaatgctgcccgatgtaaaaggaagcagagaatatattaaatggtatacggatgaagaaaaatcgctcctttgcagcagttttcatacgttgcgggatgaggcggtgttccggctgacgcttgagggattccggatagatgaggtgctgagtatgcgtctttgtgactatcaggcggtggagcggctgatacagccttcacgttctaagaggaggcagactgtggtcagtgggtatgagaataagcttcgtaccgtgaggatatgtgaagaaacggtgcgagtattgaacgattatctttttgtagagcggccgtttgctgaaaatgagggaggaatcatcagtgactggctatttctcactttacgcgggaaatcggtgggacggcctttgacctatcataactaccgcaagataatgaggaactgtgcagaacgctgtggctttgcagcagtgtacatcagaacccacagtggcagaagcacaaaggtaatggaggtattggagcaaaatgcgttacatccggagcaggaaaagtcagatatccaaatcaaggctttgtttggctggtcgcagattgattccattcagccgtatatggaccacaacagtgaaatcatggccaatgccgcatataagcgtcatagtaaaaaggatggtggcggcgatgattaaaattacacagagaatcaccgcttctgctgtctgggacattgaggggaccgaggtgcgactgccgtatcggaaggagtatccggagtcagtaatgagaaagaaaattgaggattaccggagtgctttggaaagcagggcttatgagcaggacaatactgggctttgtaaagcgttctctttctttggagggattgctttcgttacaatcggactatcctgccgagaagtatttctgcgatgcttttcttattacgcaatgcagtttgcacaggagtgggctgatggagaaaagcgcctgaaatcaaaatacattggatatgaatacgtgtttgcaaagatgctgcaaaatgaaaatataacaattcagtatgatttccgttatatattagatcaggcaagtggagaagagttctgtcagaggaatgaggcggcttttgcagagcattggataccagtcatgcggcctctaatgaaaaacggtttatctctttcggaagtgtcaaacagggtaggtgatgtaagggtatccaggtatctgatgcagataacagaccagacgcttgcttatttaaaagggattgccgttggttacacgcaaaggcgggaattaattacccttacgaaaatgaacacctttattctgggaaataacagccggacagagtttgcaggtgcagaaccggaatttcttaagctactaaggcaggttacagaggaagaaacagaactccagaggacgcagtttattaaggaaaataggaaagaaatgacacttcataaggaggtgtggattttatatcaaagacatggagcaggtcttaaacggctgactgtggatttctgtaaggtaaatcggccgtcactccgtaaggagataaagtgtttcctaaagatgagattttcaggccatgtacgcgtcagtgacagaagccacctttccatttttgatgcggtgaaccggatttgtgaaatgaatgattgcatccggtatttctctgatatcgaccatatggacgttaaaaagctgcagctatctcttgaatctgagatggatcaatcaaaaatcatgacgatgttttctgcctgtcgaactctttaccgttatctctgctcggacgagaatgagagcaagctcccaaaaccttataataacccgttcgagagcctgcattttgtcaacgctaagaaataccataagaatacaccatatattccggacaaggtaatagaagaactttctgaccgtctggaggaactggatgagacggacaggctggtatttcagatattctctgaaaccggaatgcgggccaaagaggtggcatttttagaggcgggctgtcttgaaaatgcccgttatgatggggcggtaagactaaaatacattccttacaagacgctaaaggccagacgccgcaacggaatcggcgagcgtcatagtgtttacatctcgccagtgttagcagagaaaatcaaaaagcagattactgtcagtgaggaacttcgcagggaacatagtcttccttatatttttctgcatcagaagaaaggctataaggttgcaatgctgaatgtagagtatttcatttcaaaagtaaataagctgattcataaatatgagatttgtgatgacagcggcgagctttggaactttaccagcagacagtgccgcaaaacacttgtggtaaacatgattgaaaacggcgccaccaccatggaacttgtctatcaactggggcatttgaaccagagcacagtcatgcagtattatgcggaagttaaatcagccagactggcagaaatgaataccaagttttttaaagagcagtttcacctgttgttatccgatgaacagcttaccacgttctcggaagaagagagacggctcttatatgttgattttcgtttgggaaagcgccgtgtagaattcggtttctgtacaaggaaactgtgcgatggggcatgtaaaagccgtagccgttctgtccattgtgccaactgcccgcatctgtgcacgggaataaaatatctgccattctggaaagaattgctgcagtctcaggaagcacggatgcaggtattgataaagggctatcaacgggtggaagtagcagattatgaagaatatatagagtaccggcaggaaatgcagttattggctgcttataggaatatcgttgagatgatagagaaaagtggaggtagttgtctatgagtgcgataccaaaacagaagtatattgagtattacaggaaatgtgaggaaaagcggtatcgggattttttagacagcttatctgacagcatttcttttgaaagtgacaggtggatctgtgagaagcggcttaaaaatcagtcccagcttctgagcaaggtcacgatttatttttcgatggttccagagcagcatagagagatggtgaaatattttgcactgatccggttagtggaggggaaaggagtagggacagtttgcggaaacgtgggaaatattgctatctttcttcggtttatggcagatagttctctgtcagaaattcaggtgacaacggcttcacggtttaaagaatatttggatggaaaaggctacagtgaaagtagcagaagcagtatctggtcagccgtgggtatttttcttaatcggatgagtgattttgaaaaaacgaaactgccgaatcctttttataataacccttatcaatcaaagcagcttgtagatcagaaatatatacaggaatatgtagcaaagcagcttgaccggatatttatggaagaggatattcctgtgacaatacgctgcatttactggctgctacgactgattccatcaagggtatcggagattttgggtatgaagattgaatgtctcaagccttttgatggacattactgtctctttattcctatgtggaaacaaaacggcgggtataaagagccaatcatgcgtactattcacatcgagaatgaggaaatgggaggacaactgattgctttaattcaggagcagcaaaagatggcaatgtcttaccaatgttatctgccggaagagaagcaaggggcgctgtttgcataccggtcacagattctgcaaaatggtgtttggtattcggaaaacagatacagtgtggcatcatggccgcatatatcctatcagttaaaagagatttgcaggagatatgatgtacgggatgggaatggagcagcgtatgtggtaacttcgcacaagttccgtcataatggggttacagaccggctcagagcaggatttactctgccgcaaatcgcagagatgacagcacaccatggcacggcaatgctttatgcctcgtatgcgcatctaaatctgttccctgagacaatagtagagccaatgaagtatcagacagaggcagagaatccatatgtgctgtttggaggaaggattctgaatatggattctgttacagagtcaagattgcttaaaaatatccgcgcccacagggtgccgggtggagtatgtgctgatgtcactcattgcaggagcggtgtttgggaatgcatcagttgtaaggattttgtgccggaaatggaacaactggtatatttcaaggagcaggcggctgattgggaatctaaagcggagaagttcaggagcgacagacagcttgcagataattttgcggcgatagccgcaggatttaaagccattgtggaaaaattggaaagaggggacggggatgggaaggaataaaggactgcccaagcaattaacagagaaacaggagcttttgcgtcagcagtcaatcaataaggttttgagagcgatgggggaactgaaggcggagggaagaagcgtgacgattacagcgctggtagaatttacagggctttcccggtccgtattttcaaaagagcatatcagggaactgcttgtggactatggatattccgggataaagacgcaggagcgtaagaagagtacaaagaaagaaaaattggcggatattgtagctgaaaaggatagaaagatacaggaacttcgcacagagaaggaggaattggaaagagagtgtgagttgctgcgtgggaggatattccttcttatgcagggtgaagcaagaaaatagtggcgtaaaaacagcagctttcatttcatgaaaataaaaatatacaaataaatacagaaataacggaaatagatgttgatttattcgtaaaatggcatataataagattaagagcgtaaaagagtgtgagatgaaggagagtgccatgctgatacagtttaactttaaaaattttaaatccttccgggatgaggtatccctggatttgtcggctacaaaaataacggagcatgaagatcatgtggtggagatggcaaatgataagctgttgaaggttgcggccatctatggtgccaatgctagcggaaagtctaacatttacgatgcttttaaattcatgagctattatgtggaggaatcctttaagtttggcggtgaaagcgacagcaggcaaaaagcagattcggattacattagggtaagcccgtttttgtttgacagcaagagcaggagtgaggaatcaacctttgaagtgttctttgttgataattcagagaatacgggaaaaatttatcagtatgggtttgcgctgcagaatgacgaagtggtggaggaatggttttattccaaggccaagacagcgagaaaccgatataagactattttttaccgaaaaaagggagaagaactggaagtaaacgggctgccaaagagtagtattgaaaatattaaggttgcattggaaaaggagactctgattgtatcgctaggggcaaagctgaagatatcgaaactgaaaagggtaagggactggtttctgaataacgaggttgtggacttcggaaatcccgcagagaactttttccgttcccaggtgctgccgaaaggttttaccacaagtagggaaatacagagcaatgtagtaaactattttgcatcatttgataatgccatttgtgattttaaagtggaggaagttcagcgggaaattgaaaaagagtctgatctcagttataagattgacgcattgcataagatggcagattgtgatgaatttgaatccattccgttgaaaagtgaatccagcggaacgttgaagatgtttgccctatatccatctttgaaagaggtgcttgataatggcggtaccctgtttgtagatgaactgaatgcaaggcttcatccgttattggttagaaacatcatattgacctttttatcaccggaaatcaacaccaaccatgcgcagatgatttttaccacacatgacatctggcagttatccaatgagctgttgcgccgggatgagatatggctggtggacaagaatcaggatggagtttccgatttgtattcccttgctgatttcaaggatgaagacggaaacaaggtacgccgtgatgaagcgctggcaaagaattatttgacgggtagctatggcgctatccctgcgctccgacctatggaaatgttaaaggggaggagcacggatggcgaataagagtggaggaaagctcagtgaccgcagggccggtaagaggaaagaccggaaccagcggatggggcagagagtaccggaactgggatattacctgattgtgacagacaccgaggaaacggagaagaattattttgagggacttcgtgacagcataccgacagaactgaaagatcgactgattattaaggtggagaaggccaagacggtagaactggtaaaaagggctttggagcttgtcggaaaagaatcacaatatcggataccatggattgtatttgaccgggatcaggtgaagggatttgatgaaattatatggacggcggagaaaaacggggtacatgccggatggtcaaatccctgctttgagatatggatgtatgcgtattttggggagatgcctgcaatcagggaatcttatacctgctgtgaccggtttgcggataagtttgagaaggttaccgggcagaagtatcataagaacgatagggatgtttattgcaagctggtacagtatggtgattttgaacaggcggttgtattgtcagacagaagtttgaagaagtgtgtggacgatgggaagaagctgccatcggagatgtggccggcttgtatggtgcagcggttggtggcggaaatttataacaaggtacatatggagagagaataatgaaaataaagtacatggagattcaaaattttagaagattaaaaaattgcaaaattgaattaggggataagaacacgctttttgtgggagccaataatagtggaaaaacatctgctatgaatgcattggttaaatttttgactaaatcatcattgtttaccatcaatgattttactgtgataaattggaatactatcataagtataggaaaaacattattaaaagaagaattggaagaagaggagaagaaaaaattaacattaacaacttggagaaaaattgttccgtccttagatgtctggatagaggcgggtgaagatattgatcttttacgagagattattcctacacttgaatggggagataagctaattggtgtaagaatgagcttagaaccaaccgatttaaataagctctatcaggactttttaaaggcattaagggcggctgaaacaataagaacagaaaaaagtatagaagattctgatgaaggctcagctgaagagattaatttatggccagtaaatctgttggattttttggaaagaagattggataaatatttttctgttacttactatgtattagatccggatttaatagacgaaataagtaacatacctcaagaactttcggataaagctttaccgagaaagcataatccacttaaaggaataattagagttgatttaataccggcacagagagatttctcaaattctgattttgattctaatgcgaacagtaaaaagggaaagttatcggaacaattgcaagattactataaagagcatttggatccggagaaaacgccaactaaaaacgatagagaggctattctggcaatacggaaggcagaaaaaacatttgatgataagcttacagcaggttttgaaaatgcaattaaggaattagaacaattaggatatcctgggattgcaaatccacagattacgatttcaactaaattaagtttaatagatggacttgaccataagtcagctgttaaatattcagtatctgatgatggttctttggaattgccagagaagtataatgggttagggtaccaaaatcttatttctatggtgtttaaattgatgagctttagagattcgtggatgagaacaggaaaggcaaataacgagatagatgacgaggatgaggacgcggagaaaattgaaccaatacatttagtactaattgaggaaccagaagcgcatcttcatgcgcaagtacagcaggtatttataaaacaagcatataaagtattacgaaatcatcaagaacttggcgatagtgatgaatatgcaacacaattaataataagtacacattcgagctacatagtacatgcagcagaatttaaagatttgagatactttaaaagaattaaaccgaaagatataaaggatattccaatatcggttattgttaatatgtccgatgtctttgaaaaaaagggggaaatgaactccacagaacgctttgtggttagatatctgaagactacccattgtgatttattttttgcggatgcagttattttgatagaaggggcggcagagcgtattttgttacctaagtttattgaaaaatttagtgtattgaatagttgttatatttctttactcgaaattaacggaagccatgcacaccgtttacgaccattgattgaaaaattgggaataacatgccttattattacggatttagatgcaatttgctcagagaaaaatagaaaatcagtaattcctcaacggaaaaagggacaaatttctaatagtgccacattgaagaattgggttccacaaaatgaagatattgattatttattgaacttagcagaagccgacaagatggtagcgttaaatggggatagtgatagctttgtaagagtagcatatcagacaccaattaaaatatctttaacaggtaagcgtaaaatagaaatgttatctaatacgtttgaggacgcattggtttataaaaattatgatatttttaaaacaataaaaggcgcaggactgataaagaagtttagtgatgctgttacgagttgtgatactaagtccaaacttaataaaagaatttttgaaatattaaaggataagaatattcggaaggctgaatttgcattagacttactattttctgacgaatatgatgaagttcaaatgccagattatattgaaaacggcctgaagtggttggaaaagcagttggaaagaaaaaaagagcaattattgcaggaggaggctatccatgactgagtttaacatactcaatgacaataatagggatgaccatgtagataaagagattttatcctgctatatgaaaaaaccatataatagcttttttgtatttgctggagcaggttcaggaaaaactagaagtcttgttaagcttttattaggactacgggaactgaatgggggcccttataaacgtaagggaaagaaaattgccgtaattacgtatactaatgctgcttgtgacgaaataatgagaagagttgagtatgactcattattttccatttcaacgattcatagttttgtttggaacttgataaatccttatcagaaagatattaaggagtggattaccaataaaatagctattactttagatgatttaaaagataagcaaagtagaagtcgggatttaaataatccaacttctagggagcgacaaagaaaaatagataaggcatacctgcgtttggaagtaattagagatattaaatatttcgtgtataatccaaatggagataatactactgtggattctttaagccatagtgaagttatagaaatggggaaggatttcttatttaataaaccattgctaaaaaaaatacttataaaaagctatccaattatattaattgatgaaagtcaagatacaaaaaaagagttaatggaggcttttctgcaaattcagaaagaatatagtcaggatttttcgataggactatttggtgatatgatgcagcggatttatgcagatggaaaatcagatttactagaggagattaattgtagaggagatgattggttaaaaacagaaaaaataatgaatcatagatgttgtaaaagaatcgttgagttaataaataggattcgtttagatgttgatggattgcaacaaaaaccgaggacagacaaagatgtagggaaggttcatttgtttgtcaccaccccaagtgataataaggggatggttgaagataaagcagcaaaaagaatgatagagataacagaaaatattggctgggagaatgattttgaaaagttgattctagagcatcatatggcagctagaagattgaaatttaatgaactttttgagccgctttatgaaattgatagatacaaaaattcaatattagatggaacacttacagaattatctttttttactaatattgttttgccattggttaatgctggagagagaaatgaccagtttgaaataatgagattgcttaaagaatactccccaatgcttaaaaatcttgatacgaaattgtctaaagaaactttattacaaataaagtgttctgtagaaaagttattgcatttgtggaaaaatggaaacaatcctagttgttatgaggtgctaaggactatttgtgaagaaggtattgtagatataccaccattacttagagaagtggcttttgatagtattgaactaccagatgatgatgaaattatatcagtttggagacgtgtcataaaagtgccatttagccagattgcatcatatgataaatatattaatggtaagtcaggctttatgacgcaccaaggtgttaaaggcttagaatttcctagagtaatggttataattgatgatagcgaggcaaaaggttttatgttcagctatgaaaaattatttggtgtaaaagataagactcaaacggatattaaaaatgagaatgagggaaaggatacaagtatactaagaacaaaaagattgttttatgtggcatgtagtagagcagaagaggatttggcaatagttatttatactcagagtcctcaaattgtaaagaaaagagttctggcagaagaatggtttctggaaaatgaaatagaaataatataaggatacaaaacacggttgaacctgaaaattcaatcgtgtttttatatacaaaaatttaagaaagcgaggaaaatcgaatgaataaagcaatttaccaaccaaagtactggcactacctaaccggagattttttcaatcgtgtacatccaaggttcagaaaag

SEQ ID NO: 5 - skipped
